United States Patent
Edinger et al.

(10) Patent No.: US 7,109,000 B2
(45) Date of Patent: Sep. 19, 2006

(54) PROTEINS AND NUCLEIC ACIDS ENCODING SAME

(75) Inventors: Shlomit R. Edinger, New Haven, CT (US); John R. MacDougall, Hamden, CT (US); Isabelle Millet, Milford, CT (US); Karen Ellerman, Branford, CT (US); David J. Stone, Guilford, CT (US); Valerie Gerlach, Branford, CT (US); William M. Grosse, Branford, CT (US); John P. Alsobrook, II, Madison, CT (US); Denise M. Lepley, Branford, CT (US); Daniel K. Rieger, Branford, CT (US); Catherine E. Burgess, Wethersfield, CT (US); Stacie J. Casman, North Haven, CT (US); Kimberly A. Spytek, New Haven, CT (US); Ferenc L. Boldog, North Haven, CT (US); Li Li, Branford, CT (US); Muralidhara Padigaru, Branford, CT (US); Vishnu Mishra, Gainesville, FL (US); Meera Patturajan, Branford, CT (US); Suresh G. Shenoy, Branford, CT (US); Luca Rastelli, Branford, CT (US); Velizar T. Tchernev, Branford, CT (US); Corine A. M. Vernet, Branford, CT (US); Bryan D. Zerhusen, Branford, CT (US); Uriel M. Malyankar, Branford, CT (US); Xiaojia Guo, Branford, CT (US); Charles E. Miller, Guilford, CT (US); Esha A. Gangolli, Madison, CT (US)

(73) Assignee: CuraGen Corporation, Branford, CT (US)

( * ) Notice: Subject to any disclaimer, the term of this patent is extended or adjusted under 35 U.S.C. 154(b) by 469 days.

(21) Appl. No.: 10/087,684

(22) Filed: Mar. 1, 2002

(65) Prior Publication Data

US 2004/0029116 A1 Feb. 12, 2004

(Under 37 CFR 1.47)

Related U.S. Application Data

(60) Provisional application No. 60/274,194, filed on Mar. 8, 2001, provisional application No. 60/313,656, filed on Aug. 20, 2001, and provisional application No. 60/327,456, filed on Oct. 5, 2001.

(51) Int. Cl.
*C12P 21/06* (2006.01)
*C07K 1/00* (2006.01)

(52) U.S. Cl. ............... 435/69.1; 530/350; 536/23.1
(58) Field of Classification Search .......... 435/69.1; 530/350; 536/23.1; 514/2
See application file for complete search history.

(56) References Cited

FOREIGN PATENT DOCUMENTS

| WO | WO 98/37085 | 8/1998 |
|---|---|---|
| WO | WO 01/40466 | 6/2001 |
| WO | WO 02/29058 | 4/2002 |

OTHER PUBLICATIONS

Carninci et al. Normalization and subtraction of cap–trapper–selected cDNAs to prepare full–length cDNA libraries for rapid discovery of new genes. Genome Res. Oct. 2000;10(10):1617–30.*
Alderborn, et al. (2000). *Genome Res* 10(8): 1249–58.
Ardini, et al. (2000). "Expression of protein tyrosine phosphatase alpha (RPTPalpha) in human breast cancer correlates with low tumor grade, and inhibits tumor cell growth in vitro and in vivo." *Oncogene* 19(43): 4979–87.
Augustine, et al. (1993). "Antisense attenuation of Wnt–1 and Wnt–3a expression in whole embryo culture reveals roles for these genes in craniofacial, spinal cord, and cardiac morphogenesis," *Dev Genet* 14(6): 500–20.
Berndt, et al. (1999). "Expression of the transmembrane protein tyrosine phosphatase RPTPalpha in human oral squamous cell carcinoma." *Histochem Cell Biol* 111(5): 399–403.
Bocchinfuso, et al. (1999). "A mouse mammary tumor virus–Wnt–1 transgene induces mammary gland hyperplasia and tumorigenesis in mice lacking estrogen receptor–alpha." *Cancer Res* 59(8):1869–76.
Braisted, et al. (2000). "Netrin–1 promotes thalamic axon growth and is required for proper development of the thalamocortical projection." *J. Neurosci* 20(15): 5792–801.
Brisken, et al. (2000). "Essential function of Wnt–4 in a mammary gland development downstream of progesterone signaling." *Genes Dev* 14(6): 650–4.
Daniel, et al. (1994). "Mammalian alpha–mannosidases—multiple forms but a common purpose?" *Glycobiology* 4(5): 551–66.
Dubiel, W., K. Ferrell, et al. (1992). "Subunit 4 of the 26 S protease is a member of a novel eukaryotic ATPase family," *J. Biol Chem* 267(32): 22699–702.

(Continued)

*Primary Examiner*—Jon Weber
*Assistant Examiner*—Agnes Rooke
(74) *Attorney, Agent, or Firm*—Daniel K. Rieger; George M. Yahwak

(57) ABSTRACT

Disclosed herein are nucleic acid sequences that encode novel polypeptides. Also disclosed are polypeptides encoded by these nucleic acid sequences, and antibodies, which immunospecifically-bind to the polypeptide, as well as derivatives, variants, mutants, or fragments of the aforementioned polypeptide, polynucleotide, or antibody. The invention further discloses therapeutic, diagnostic and research methods for diagnosis, treatment, and prevention of disorders involving any one of these novel human nucleic acids and proteins.

10 Claims, No Drawings

OTHER PUBLICATIONS

Ellezam, et al. (2001). "Expression of netrin–1 and its receptors DCC and UNC–5H2 after axotomy and during regeneration of adult rat retinal ganglion cells." *Exp Neurol* 168(1): 105–15.
Feighner (1999). "Mechanism of action of antidepressant medications." *J Clin Psychiatry* 60(Suppl 4): 4–13.
Ferry and McGaugh (2000). "Role of amygdala norepinephrine in mediating stress hormone regulation of memory storage." *Acta Pahrmacol Sin* 21(6): 481–93.
GenBank Accession No.: A44468 (Jun. 2, 2000).
GenBank Accession No.: A49502 (Apr. 24, 1998).
GenBank Accession No.: A53791 (Jun. 11, 1999).
GenBank Accession No.: AAF21809 (Jan. 1, 2000).
GenBank Accession No.: AAF45755 (Oct. 4, 2000).
GenBank Accession No.: AAF45998 (Oct. 4, 2000).
GenBank Accession No.: AAF53837 (Oct. 4, 2000).
GenBank Accession No.: AAH01280 (Jul. 12, 2001).
GenBank Accession No.: AAH08983 (Jul. 12, 2001).
GenBank Accession No.: AAH16253 (Nov. 5, 2001).
GenBank Accession No.: AAH16368 (Nov. 5, 2001).
GenBank Accession No.: AAK13590 (Mar. 1, 2001).
GenBank Accession No.: AAK82958 (Aug. 2, 2001).
GenBank Accession No.: AB004816 (Apr. 24, 1998).
GenBank Accession No.: AB018348 (Jun. 16, 1999).
GenBank Accession No.: AB024080 (Dec. 8, 2000).
GenBank Accession No.: AB063483 (Oct. 20, 2001).
GenBank Accession No.: AE003423 (Oct. 4, 2000).
GenBank Accession No.: AE003663 (Oct. 4, 2000).
GenBank Accession No.: AF008551 (Apr. 7, 1998).
GenBank Accession No.: AF031168 (Jan. 22, 1998).
GenBank Accession No.: AF044414 (Oct. 27, 1999).
GenBank Accession No.: AF063249 (Sep. 9, 1998).
GenBank Accession No.: Af095154 (Oct. 15, 1998).
GenBank Accession No.: AF096286 (Jan. 1, 2000).
GenBank Accession No.: AF154413 (Mar. 1, 2001).
GenBank Accession No.: AF233450 (Aug. 2, 2001).
GenBank Accession No.: AI255192 (Nov. 12, 1998).
GenBank Accession No.: AL005132 (Sep. 18, 1997).
GenBank Accession No.: BAA25784 (Apr. 24, 1998).
GenBank Accession No.: BAA83743 (Dec. 8, 2000).
GenBank Accession No.: BAB23831 (Jan. 19, 2002).
GenBank Accession No.: BAB70499 (Oct. 20, 2001).
GenBank Accession No.: BC001280 (Jul. 12, 2001).
GenBank Accession No.: BC016368 (Nov. 5, 2001).
GenBank Accession No.: D86948 (Mar. 31, 2000).
GenBank Accession No.: I50720 (Oct. 7, 1997).
GenBank Accession No.: JC5974 (Jan. 21, 2000).
GenBank Accession No.: L02426 (Sep. 27, 1993).
GenBank Accession No.: M80776 (Dec. 31, 1994).
GenBank Accession No.: NM_002802 (Oct. 31, 2000).
GenBank Accession No.: NM_003158 (Oct. 31, 2000).
GenBank Accession No.: NM_003395 (Nov. 15, 2001).
GenBank Accession No.: NM_003600 (Nov. 1, 2000).
GenBank Accession No.: NM_008596 (Jan. 7, 2002).
GenBank Accession No.: NM_008947 (Jan. 7, 2002).
GenBank Accession No.: NM_009522 (Jan. 7, 2002).
GenBank Accession No.: NM_022925 (Jan. 31, 2001).
GenBank Accession No.: NP_002793 (Oct. 31, 2000).
GenBank Accession No.: NP_003149 (Oct. 31, 2000).
GenBank Accession No.: NP_003386 (Nov. 15, 2001).
GenBank Accession No.: NP_003591 (Nov. 1, 2000).
GenBank Accession No.: NP_032622 (Jan. 7, 2002).
GenBank Accession No.: NP_032973 (Jan. 7, 2002).
GenBank Accession No.: NP_033548 (Jan. 7, 2002).
GenBank Accession No.: NP_075214 (Jan. 31, 2001).
GenBank Accession No.: O14905 (Dec. 15, 1998).
GenBank Accession No.: O42280 (Jul. 15, 1999).
GenBank Accession No.: O75973 (Oct. 16, 2001).
GenBank Accession No.: O88992 (Oct. 16, 2001).
GenBank Accession No.: P02746 (Oct. 16, 2001).
GenBank Accession No.: P10108 (Jul. 15, 1999).
GenBank Accession No.: P16621 (Mar. 1, 2002).
GenBank Accession No.: P20488 (Jul. 15, 1998).
GenBank Accession No.: P21139 (May 30, 2000).
GenBank Accession No.: P25098 (Aug. 20, 2001).
GenBank Accession No.: P26817 (Oct. 16, 2001).
GenBank Accession No.: P42280 (Oct. 1, 1996).
GenBank Accession No.: P51805 (Oct. 16, 2001).
GenBank Accession No.: Q90732 (Nov. 1, 1997).
GenBank Accession No.: U87306 (May 15, 1997).
GenBank Accession No.: XM_009546 (Oct. 16, 2001).
GenBank Accession No.: XM_027243 (Oct. 16, 2001).
GenBank Accession No.: XP_009546 (Oct. 16, 2001).
GenBank Accession No.: XP_027243 (Oct. 16, 2001).
Giet and Prigent (1999). "Aurora/lpl1p–related kinases, a new oncogenic family of mitotic serine–threonine kinases." *J Cell Sci* 112(Pt 21): 3591–601.
Hall, et al. (2000). "Axonal remodeling and synaptic differentiation in the cerebellum is regulated by WNT–7a signaling." *Cell* 100(5): 526–35.
Hoyle and Fisher (1996). "Genomic organization and mapping of the mouse P26s4 ATPase gene: a member of the remarkably conserved AAA gene family." *Genomics* 31(1): 115–8.
Kennedy and Ramachandran (2000). "Protein tyrosine phosphotase– 1B in diabetes." *Biochem. Pharmacol* 60(7): 877–83.
Komazaki, et al. (1999). "Immunolocalization of mitsugumin29 in developing skeletal muscle and effects of the protein expressed in amphibian embryonic cells." *Dev Dyn* 215(2): 87–95.
Krueger and Saito (1992). "A human transmembrane protein–tyrosine–phosphatase, PTP zeta, is expressed in brain and has an N–terminal receptor domain homologous to carbonic anhydrases." *Proc Natl Acad Sci U S A* 89(16): 7417–21.
Kuhl, et al. (2000). "The Wnt/Ca2+ pathway: a new vertebrate Wnt signaling pathway takes shape." *Trends Genet* 16(7): 279–83.
LaBonne and Furst (1989). "Differentitation in vitro of neural precursor cells from normal and Pecanex mutant *Drosphila* embryos." *J Neurogenet* 5(2): 99–104.
LaBonne, et al. (1989). "Molecular genetics of pecanex, a maternal–effect neurogenic locus of *Drosphila melanogaster* that potentially encodes a large transmembrane protein." *Dev Biol* 136(1): 1–16.
Lue, et al. (2001). "Inflammatory repertoire of Alzheimer's disease and nondemented ederly microglia in vitro." *Glia* 35(1): 72–9.
Minassian, et al. (1998). "Mutations in a gene encoding a novel protein tyrosine phosphatase cause progressive myoclonus epilepsy." *Nat Genet* 20(2): 171–4.
Murakami, et al. (2001). "Differential expression of plexin–A subfamily members in the mouse nervous system." *Dev Dyn* 220(3): 246–58.

Nishi, et al. (1999). "Abnormal features in skeletal muscle from mice lacking mitsugumin29." *J Cell Biol* 147(7): 1473–80.

Pasterkamp, et al. (1999). "Semaphorins and their receptors in olfactory axon guidance." *Cell Mol Biol* (Noisy–le–grand) 45(6): 763–79.

Powell, et al. (1997). "Development of polarity in cerebellar granule neurons." *J Neurobiol* 32(2): 223–36.

Samy, et al. (1999). "Proteasome participates in the alteration of signal transduction in T and B lymphocytes following trauma–hemorrhage." *Biochim Biophys Acta* 1453(1): 92–104.

Seversen, A. F., D. R. Hamill, et al. (2000). "The aurora–related kinase AIR–2 recruits ZEN–4/CeMKLP1 to the mitotic spindle at metaphase and is required for cytokinesis." *Curr Biol* 10(19): 1162–71.

Shimuta, et al. (1998). "Structure and expression of mitsugumin29 gene." *FEBS Lett* 431(2):263–7.

SWALL (SPTR) Accession No.: O08722 (Jul. 1, 1997).
SWALL (SPTR) Accession No.: O08747 (Jul. 1, 1997).
SWALL (SPTR) Accession No.: O60445 (Aug. 1, 1998).
SWALL (SPTR) Accession No.: O88488 (Nov. 1, 1998).
SWALL (SPTR) Accession No.: O95185 (May 1, 1999).
SWALL (SPTR) Accession No.: P49014 (Jun. 1, 1994).
SWALL (SPTR) Accession No.: P70206 (Feb. 1, 1997).
SWALL (SPTR) Accession No.: P70208 (Feb. 1, 1997).
SWALL (SPTR) Accession No.: Q13358 (Nov. 1, 1996).
SWALL (SPTR) Accession No.: Q91823 (Nov. 1, 1996).
SWALL (SPTR) Accession No.: Q99LLB (Jun. 1, 2001).
SWALL (SPTR) Accession No.: Q99MK8 (Jun. 1, 2001).
SWALL (SPTR) Accession No.: Q9D398 (Jun. 1, 2001).
SWALL (SPTR) Accession No.: Q9ESN4 (Oct. 16, 2001).
SWALL (SPTR) Accession No.: Q9NTJ4 (Oct. 16, 2000).
SWALL (SPTR) Accession No.: Q9QYC1 (May 1, 2001).
SWALL (SPTR) Accession No.: Q9UIW2 (May 1, 2000).
SWALL (SPTR) Accession No.: Q9UL64 (May 1, 2000).

Takeshima, et al. (1998). "Mitsugumin29, a novel synaptophysin family memeber from the triad junction in skeletal muscle." *Biochem J* 331(Pt 1): 317–22.

Tamagnone, et al. (1999). "Plexins are a large family of receptors for transmembrane, secreted, and GPI–anchored semaphorins in vertebrates." *Cell* 99(1): 71–80.

Tanahashi, et al. (1998). "Chromosomal localization and immunological analysis of a family of human 26S proteasomal ATPases." *Biochem Biophys Res Commun* 243(1): 229–32.

Tappia, et al. (1993). "Regulation of an hepatic low–Mr(r) membrane–associated protien–tyrosine phosphatase." *Biochem J* 292(Pt 1): 1–5.

Thomas, et al. (1994). "GLEPP1, a renal glomerular epithelial cell (podocyte) membrane protein–tyrosine phosphatase. Identification, molecular cloning, and characterization in rabbit." *J Biol Chem* 269(31): 19953–62.

Vite, et al. (2001). "Histopathology, electrodiagnostic testing, and magnetic resonance imaging show significant peripheral and central nervous system myelin abnormalities in the cat model of alpha–mannosidosis." *J Neuropathol Exp Neurol* 60(8): 817–28.

Wooton and Federhen (1996). "Analysis of compositionally biased regions in sequence databases." *Methods Enzymol* 266: 554–71.

Wright, et al. (1998). "Proliferating and migrating mesangial cells responding to injury express a novel receptor protein––tyrosine phosphatase in experimental mesangial proliferative glomerulonephritis." *J Biol Chem* 273(37): 23929–37.

Zelivianski, et al. (2000). "Expression of receptor protein tyrosine phosphatase alpha mRNA in human prostate cancer cell lines." *Mol Cell Biochem* 208(1–2): 11–8.

Zmuda and Rivas (1998). "The Golgi apparatus and the centrosome are localized to the sites of newly emerging axons in cerebellar granule neurons in vitro." *Cell Motil Cytoskeleton* 41(1): 18–38.

Ackerman, et al. (1997). "The mouse rostral cerebellar malformation gene encodes an UNC–5–like protein." *Nature* 386(6627): 838–42.

Sen, et al. (1997). "A putative serine/threonine kinase encoding gene BTAK on chromosome 20q13 is amplified and overexpressed in human breast cancer lines." *Oncogene* 14(18):2195–200.

Shindo, et al. (1998). "cDNA cloning, expression, subcellular localization, and chromosomal assignment of mammalian aurora homologues, aurora–related kinase (ARK) 1 and 2." *Biochem Biophys Res Commun* 244(1): 285–92.

Zhou, et al. (1998). "Tumor amplified kinase STK15/BTAK induces centrosome amplification, aneuploidy and transformation." *Net Genet* 20(2): 189–93.

EMBL Accession No.: AK022859 (Sep. 29, 2000).

Hedgecock, et al. (1997). Tren in Genet 13(7): 251–253

International Search Report for PCT/US 01/48922, mailed Feb. 28, 2003.

Komatsuzaki, et al. (2002). Biochem Biophys Res Comm 297(4): 898–905.

Leonardo, et al. (1997). Nature 386(6627): 833–838.

Nagase, et al. (1998). DNA Res 5: 277–286.

* cited by examiner

PROTEINS AND NUCLEIC ACIDS ENCODING SAME

RELATED APPLICATIONS

This application claims priority from U.S. Ser. No. 60/274,194, filed Mar. 8, 2001; U.S. Ser. No. 60/313,656, filed Aug. 20, 2001; and U.S. Ser. No. 60/327,456, filed Oct. 5, 2001 each of which is incorporated by reference in its entirety.

FIELD OF THE INVENTION

The invention generally relates to nucleic acids and polypeptides encoded thereby.

BACKGROUND OF THE INVENTION

The invention generally relates to nucleic acids and polypeptides encoded therefrom. More specifically, the invention relates to nucleic acids encoding cytoplasmic, nuclear, membrane bound, and secreted polypeptides, as well as vectors, host cells, antibodies, and recombinant methods for producing these nucleic acids and polypeptides.

SUMMARY OF THE INVENTION

The invention is based in part upon the discovery of nucleic acid sequences encoding novel polypeptides. The novel nucleic acids and polypeptides are referred to herein as NOVX, or NOV1, NOV2, NOV3, NOV4, NOV5, NOV6, NOV7, NOV8, NOV9, NOV10, NOV11, and NOV12 nucleic acids and polypeptides. These nucleic acids and polypeptides, as well as derivatives, homologs, analogs and fragments thereof, will hereinafter be collectively designated as "NOVX" nucleic acid or polypeptide sequences.

In one aspect, the invention provides an isolated NOVX nucleic acid molecule encoding a NOVX polypeptide that includes a nucleic acid sequence that has identity to the nucleic acids disclosed in SEQ ID NOS:1, 3, 5, 7, 9, 11, 13, 15, 17, 19, 21, 23, 25, 27, 29, 31, and 217. In some embodiments, the NOVX nucleic acid molecule will hybridize under stringent conditions to a nucleic acid sequence complementary to a nucleic acid molecule that includes a protein-coding sequence of a NOVX nucleic acid sequence. The invention also includes an isolated nucleic acid that encodes a NOVX polypeptide, or a fragment, homolog, analog or derivative thereof. For example, the nucleic acid can encode a polypeptide at least 80% identical to a polypeptide comprising the amino acid sequences of SEQ ID NOS:2, 4, 6, 8, 10, 12, 14, 16, 18, 20, 22, 24, 26, 28, 30, 32, and 218. The nucleic acid can be, for example, a genomic DNA fragment or a cDNA molecule that includes the nucleic acid sequence of any of SEQ ID NOS:1, 3, 5, 7, 9, 11, 13, 15, 17, 19, 21, 23, 25, 27, 29, 31, and 217.

Also included in the invention is an oligonucleotide, e.g., an oligonucleotide which includes at least 6 contiguous nucleotides of a NOVX nucleic acid (e.g., SEQ ID NOS:1, 3, 5, 7, 9, 11, 13, 15, 17, 19, 21, 23, 25, 27, 29, 31, and 217) or a complement of said oligonucleotide.

Also included in the invention are substantially purified NOVX polypeptides (SEQ ID NOS:2, 4, 6, 8, 10, 12, 14, 16, 18, 20, 22, 24, 26, 28, 30, 32, and 218). In certain embodiments, the NOVX polypeptides include an amino acid sequence that is substantially identical to the amino acid sequence of a human NOVX polypeptide.

The invention also features antibodies that immunoselectively bind to NOVX polypeptides, or fragments, homologs, analogs or derivatives thereof.

In another aspect, the invention includes pharmaceutical compositions that include therapeutically- or prophylactically-effective amounts of a therapeutic and a pharmaceutically-acceptable carrier. The therapeutic can be, e.g., a NOVX nucleic acid, a NOVX polypeptide, or an antibody specific for a NOVX polypeptide. In a further aspect, the invention includes, in one or more containers, a therapeutically- or prophylactically-effective amount of this pharmaceutical composition.

In a further aspect, the invention includes a method of producing a polypeptide by culturing a cell that includes a NOVX nucleic acid, under conditions allowing for expression of the NOVX polypeptide encoded by the DNA. If desired, the NOVX polypeptide can then be recovered.

In another aspect, the invention includes a method of detecting the presence of a NOVX polypeptide in a sample. In the method, a sample is contacted with a compound that selectively binds to the polypeptide under conditions allowing for formation of a complex between the polypeptide and the compound. The complex is detected, if present, thereby identifying the NOVX polypeptide within the sample.

The invention also includes methods to identify specific cell or tissue types based on their expression of a NOVX.

Also included in the invention is a method of detecting the presence of a NOVX nucleic acid molecule in a sample by contacting the sample with a NOVX nucleic acid probe or primer, and detecting whether the nucleic acid probe or primer bound to a NOVX nucleic acid molecule in the sample.

In a further aspect, the invention provides a method for modulating the activity of a NOVX polypeptide by contacting a cell sample that includes the NOVX polypeptide with a compound that binds to the NOVX polypeptide in an amount sufficient to modulate the activity of said polypeptide. The compound can be, e.g., a small molecule, such as a nucleic acid, peptide, polypeptide, peptidomimetic, carbohydrate, lipid or other organic (carbon containing) or inorganic molecule, as further described herein.

Also within the scope of the invention is the use of a therapeutic in the manufacture of a medicament for treating or preventing disorders or syndromes including, e.g., cardiomyopathy, atherosclerosis, hypertension, congenital heart defects, aortic stenosis, atrial septal defect (ASD), atrioventricular (A-V) canal defect, ductus arteriosus, pulmonary stenosis, subaortic stenosis, ventricular septal defect (VSD), valve diseases, hypercoagulation, hemophilia, idiopathic thrombocytopenic purpura, heart failure, secondary pathologies caused by heart failure and hypertension, hypotension, angina pectoris, myocardial infarction, tuberous sclerosis, scleroderma, transplantation, autoimmune disease, lupus erythematosus, viral/bacterial/parasitic infections, multiple sclerosis, autoimmune disease, allergies, immunodeficiencies, graft versus host disease, asthma, emphysema, ARDS, inflammation and modulation of the immune response, viral pathogenesis, aging-related disorders, Th1 inflammatory diseases such as rheumatoid arthritis, multiple sclerosis, inflammatory bowel diseases, AIDS, wound repair, obesity, diabetes, endocrine disorders, anorexia, bulimia, renal artery stenosis, interstitial nephritis, glomerulonephritis, polycystic kidney disease, systemic, renal tubular acidosis, IgA nephropathy, nephrological disesases, hypercalceimia, Lesch-Nyhan syndrome, Von Hippel-Lindau (VHL) syndrome, trauma, regeneration (in vitro and in vivo), Hirschsprung's disease, Crohn's Disease, appendicitis, endometriosis, laryngitis, psoriasis, actinic keratosis, acne, hair growth/loss, allopecia, pigmentation disorders, myasthenia gravis, alpha-mannosidosis, beta-mannosidosis, other storage disorders, peroxisomal disorders such as zellweger syndrome, infantile refsum disease, rhizomelic chondrodysplasia (chondrodysplasia punctata, rhizomelic), and hyperpipecolic acidemia, osteoporosis, muscle disorders, urinary retention, Albright Hereditary Ostoeodystrophy, ulcers, Alzheimer's disease, stroke, Parkinson's disease, Huntington's disease, cerebral palsy, epilepsy, Lesch-Nyhan syndrome, multiple sclerosis, ataxia-telangiectasia, behavioral disorders, addiction, anxiety, pain, neuroprotection, Stroke, Aphakia, neurodegenerative disorders, neurologic disorders, developmental defects, conditions associated with the role of GRK2 in brain and in the regulation of chemokine receptors, encephalomyelitis, anxiety, schizophrenia, manic depression, delirium, dementia, severe mental retardation and dyskinesias, Gilles de la Tourette syndrome, leukodystrophies, cancers, breast cancer, CNS cancer, colon cancer, gastric cancer, lung cancer, melanoma, ovarian cancer, pancreatic cancer, kidney cancer, colon cancer, prostate cancer, neuroblastoma, and cervical cancer, Neoplasm; adenocarcinoma, lymphoma; uterus cancer, benign prostatic hypertrophy, fertility, control of growth and development/differentiation related functions such as but not limited maturation, lactation and puberty, reproductive malfunction, and/or other pathologies and disorders of the like.

The therapeutic can be, e.g., a NOVX nucleic acid, a NOVX polypeptide, or a NOVX-specific antibody, or biologically-active derivatives or fragments thereof.

For example, the compositions of the present invention will have efficacy for treatment of patients suffering from the diseases and disorders disclosed above and/or other pathologies and disorders of the like. The polypeptides can be used as immunogens to produce antibodies specific for the invention, and as vaccines. They can also be used to screen for potential agonist and antagonist compounds. For example, a cDNA encoding NOVX may be useful in gene therapy, and NOVX may be useful when administered to a subject in need thereof. By way of non-limiting example, the compositions of the present invention will have efficacy for treatment of patients suffering from the diseases and disorders disclosed above and/or other pathologies and disorders of the like.

The invention further includes a method for screening for a modulator of disorders or syndromes including, e.g., the diseases and disorders disclosed above and/or other pathologies and disorders of the like. The method includes contacting a test compound with a NOVX polypeptide and determining if the test compound binds to said NOVX polypeptide. Binding of the test compound to the NOVX polypeptide indicates the test compound is a modulator of activity, or of latency or predisposition to the aforementioned disorders or syndromes.

Also within the scope of the invention is a method for screening for a modulator of activity, or of latency or predisposition to disorders or syndromes including, e.g., the diseases and disorders disclosed above and/or other pathologies and disorders of the like by administering a test compound to a test animal at increased risk for the aforementioned disorders or syndromes. The test animal expresses a recombinant polypeptide encoded by a NOVX nucleic acid. Expression or activity of NOVX polypeptide is then measured in the test animal, as is expression or activity of the protein in a control animal which recombinantly-expresses NOVX polypeptide and is not at increased risk for the disorder or syndrome. Next, the expression of NOVX polypeptide in both the test animal and the control animal is compared. A change in the activity of NOVX polypeptide in the test animal relative to the control animal indicates the test compound is a modulator of latency of the disorder or syndrome.

In yet another aspect, the invention includes a method for determining the presence of or predisposition to a disease associated with altered levels of a NOVX polypeptide, a NOVX nucleic acid, or both, in a subject (e.g., a human subject). The method includes measuring the amount of the NOVX polypeptide in a test sample from the subject and comparing the amount of the polypeptide in the test sample to the amount of the NOVX polypeptide present in a control sample. An alteration in the level of the NOVX polypeptide in the test sample as compared to the control sample indicates the presence of or predisposition to a disease in the subject. Preferably, the predisposition includes, e.g., the diseases and disorders disclosed above and/or other pathologies and disorders of the like. Also, the expression levels of the new polypeptides of the invention can be used in a method to screen for various cancers as well as to determine the stage of cancers.

In a further aspect, the invention includes a method of treating or preventing a pathological condition associated with a disorder in a mammal by administering to the subject a NOVX polypeptide, a NOVX nucleic acid, or a NOVX-specific antibody to a subject (e.g., a human subject), in an amount sufficient to alleviate or prevent the pathological condition. In preferred embodiments, the disorder, includes, e.g., the diseases and disorders disclosed above and/or other pathologies and disorders of the like.

In yet another aspect, the invention can be used in a method to identity the cellular receptors and downstream effectors of the invention by any one of a number of techniques commonly employed in the art. These include but are not limited to the two-hybrid system, affinity purification, co-precipitation with antibodies or other specific-interacting molecules.

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. All publications, patent applications, patents, and other references mentioned herein are incorporated by reference in their entirety. In the case of conflict, the present specification, including definitions, will control. In addition, the materials, methods, and examples are illustrative only and not intended to be limiting.

Other features and advantages of the invention will be apparent from the following detailed description and claims.

DETAILED DESCRIPTION OF THE INVENTION

The present invention provides novel nucleotides and polypeptides encoded thereby. Included in the invention are the novel nucleic acid sequences and their encoded polypeptides. The sequences are collectively referred to herein as "NOVX nucleic acids" or "NOVX polynucleotides" and the corresponding encoded polypeptides are referred to as "NOVX polypeptides" or "NOVX proteins." Unless indicated otherwise, "NOVX" is meant to refer to any of the novel sequences disclosed herein. Table A provides a summary of the NOVX nucleic acids and their encoded polypeptides.

TABLE A

Sequences and Corresponding SEQ ID Numbers

| NOVX Assignment | Internal Identification | SEQ ID NO (nucleic acid) | SEQ ID NO (polypeptide) | Homology |
| --- | --- | --- | --- | --- |
| 1a | GMba58ol_A_dal | 1 | 2 | Transmembrane receptor UNC5H2-like |
| 1b | Gmba58ol_A | 3 | 4 | Transmembrane receptor UNC5H2-like |
| 2a | SC126422078_A | 5 | 6 | Tyrosine Phosphatase Precursor-like |
| 2b | CG50718-02 | 7 | 8 | Glomerular Mesangial Cell Receptor Protein Tyrosine Phosphatase Precursor like |
| 2c | CG50718-05 | 9 | 10 | Glomerular Mesangial Cell Receptor Protein Tyrosine Phosphatase Precursor like |
| 3 | 134899552_EXT | 11 | 12 | Human homolog of the Drosophila pecanex-like |
| 4 | SC140515441_A | 13 | 14 | Aurora-related kinase 1-like |
| 5 | SC44326718_A | 15 | 16 | 26S protease regulatory subunit 4-like |
| 6 | GMAC073364_Adal | 17 | 18 | Mitsugumin29-like |
| 7 | 106973211_EXT | 19 | 20 | Wnt-15-like |
| 8 | 88091010-EXT | 21 | 22 | Wnt-14-like |
| 9 | AC069250_28_dal | 23 | 24 | Beta-adrenergic receptor kinase-like |
| 10 | AC058790_da25 | 25 | 26 | Alpha-mannosidase-like |
| 11a | GM57107065_dal | 27 | 28 | Clq-related factor-like |
| 11b | CG54503-02 | 29 | 30 | Clq-related factor-like |
| 11c | CG54503-03 | 217 | 218 | Clq-related factor-like |
| 12 | SC132340676_A | 31 | 32 | Plexin 1-like |

NOVX nucleic acids and their encoded polypeptides are useful in a variety of applications and contexts. The various NOVX nucleic acids and polypeptides according to the invention are useful as novel members of the protein families according to the presence of domains and sequence relatedness to previously described proteins. Additionally, NOVX nucleic acids and polypeptides can also be used to identify proteins that are members of the family to which the NOVX polypeptides belong.

NOV1 is homologous to the transmembrane receptor UNC5H2-like family of proteins. Thus, NOV1 nucleic acids and polypeptides, antibodies and related compounds according to the invention will be useful in therapeutic and diagnostic applications implicated in, for example; cardiomyopathy, atherosclerosis, hypertension, congenital heart defects, aortic stenosis, atrial septal defect (ASD), atrioventricular (A-V) canal defect, ductus arteriosus, pulmonary stenosis, subaortic stenosis, ventricular septal defect (VSD), valve diseases, tuberous sclerosis, scleroderma, obesity, transplantation, diabetes, autoimmune disease, renal artery stenosis, interstitial nephritis, glomerulonephritis, polycystic kidney disease, systemic lupus erythematosus, renal tubular acidosis, IgA nephropathy, hypercalceimia, Lesch-Nyhan syndrome, Von Hippel-Lindau (VHL) syndrome, Alzheimer's disease, stroke, tuberous sclerosis, Parkinson's disease, Huntington's disease, cerebral palsy, epilepsy, Lesch-Nyhan syndrome, multiple sclerosis, ataxia-telangiectasia, leukodystrophies, behavioral disorders, addiction, anxiety, pain, neuroprotection, cancers, and/or other pathologies and disorders. Also since this gene is expressed at a measurably higher level in several cancer cell lines (including breast cancer, CNS cancer, colon cancer, gastric cancer, lung cancer, melanoma, ovarian cancer and pancreatic cancer), it may be useful in diagnosis and treatment of these cancers.

NOV2 is homologous to the protein tyrosine phosphatase precursor-like family of proteins. Thus NOV2 nucleic acids, polypeptides, antibodies and related compounds according to the invention will be useful in therapeutic and diagnostic applications implicated in, for example; cancer, kidney cancer, trauma, regeneration (in vitro and in vivo), viral/bacterial/parasitic infections, nephrological disesases including diabetes, autoimmune disease, renal artery stenosis, interstitial nephritis, glomerulonephritis, polycystic kidney disease, systemic lupus erythematosus, renal tubular acidosis, IgA nephropathy, hypercalceimia, Lesch-Nyhan syndrome, Hirschsprung's disease, Crohn's Disease, appendicitis, and/or other pathologies and disorders.

NOV3 is homologous to the Human homolog of the Drosophila pecanex family of proteins. Thus NOV3 nucleic acids, polypeptides, antibodies and related compounds according to the invention will be useful in therapeutic and diagnostic applications implicated in, for example; cancer, trauma, regeneration (in vitro and in vivo), viral/bacterial/parasitic infections, cardiomyopathy, atherosclerosis, hypertension, congenital heart defects, aortic stenosis, atrial septal defect (ASD), atrioventricular (A-V) canal defect, ductus arteriosus, pulmonary stenosis, subaortic stenosis, ventricular septal defect (VSD), valve diseases, tuberous sclerosis, multiple sclerosis, scleroderma, obesity, endometriosis, fertility, hypercoagulation, autoimmune disease, allergies, immunodeficiencies, transplantation, hemophilia, idiopathic thrombocytopenic purpura, graft versus host disease, Von Hippel-Lindau (VHL) syndrome, Alzheimer's disease, stroke, hypercalceimia, Parkinson's disease, Huntington's disease, cerebral palsy, epilepsy, ataxia-telangiectasia, leukodystrophies, behavioral disorders, addiction, anxiety, pain, neuroprotection, systemic lupus erythematosus, asthma, emphysema, ARDS, laryngitis, psoriasis, actinic keratosis, acne, hair growth/loss, allopecia, pigmentation disorders, endocrine disorders, diabetes, renal artery stenosis, interstitial nephritis, glomerulonephritis, polycystic kidney disease, systemic lupus erythematosus, renal tubular acidosis, IgA nephropathy, Lesch-Nyhan syndrome, and a variety of kidney diseases and/or other pathologies and disorders.

NOV4 is homologous to a family of Aurora-related kinase 1-like proteins. Thus, the NOV4 nucleic acids and polypeptides, antibodies and related compounds according to the invention will be useful in therapeutic and diagnostic applications implicated in, for example: breast, ovarian, colon, prostate, neuroblastoma, and cervical cancer, Cardiomyopathy, Atherosclerosis, Hypertension, Congenital heart defects, Aortic stenosis, Atrial septal defect (ASD), Atrioventricular (A-V) canal defect, Ductus arteriosus, Pulmonary stenosis, Subaortic stenosis, Ventricular septal defect (VSD), valve diseases, Tuberous sclerosis, Scleroderma, Obesity, Transplantation, Diabetes, Von Hippel-Lindau (VHL) syndrome, Pancreatitis, Alzheimer's disease, Stroke, hypercalceimia, Parkinson's disease, Huntington's disease, Cerebral palsy, Epilepsy, Lesch-Nyhan syndrome, Multiple sclerosis, Ataxia-telangiectasia, Leukodystrophies, Behavioral disorders, Addiction, Anxiety, Pain, and Neuroprotection, and/or other pathologies.

NOV5 is homologous to the 26S protease regulatory subunit 4-like family of proteins. Thus, NOV5 nucleic acids, polypeptides, antibodies and related compounds according to the invention will be useful in therapeutic and diagnostic applications implicated in, for example: cataract and Aphakia, Alzheimer's disease, neurodegenerative disorders, inflammation and modulation of the immune response, viral pathogenesis, aging-related disorders, neurologic disorders, cancer, and/or other pathologies.

NOV6 is homologous to the MITSUGUMIN29-like family of proteins. Thus, NOV6 nucleic acids, polypeptides, antibodies and related compounds according to the invention will be useful in therapeutic and diagnostic applications implicated in, for example: muscular dystrophy, Lesch-Nyhan syndrome, myasthenia gravis, diabetes, autoimmune disease, renal artery stenosis, interstitial nephritis, glomerulonephritis, polycystic kidney disease, systemic lupus erythematosus, renal tubular acidosis, IgA nephropathy, hypercalceimia, cardiomyopathy, atherosclerosis, hypertension, congenital heart defects, aortic stenosis, atrial septal defect (ASD), atrioventricular (A-V) canal defect, ductus arteriosus, pulmonary stenosis, subaortic stenosis, ventricular septal defect (VSD), valve diseases, tuberous sclerosis, scleroderma, obesity, transplantation, adrenoleukodystrophy, congenital adrenal hyperplasia, and other diseases, disorders and conditions of the like. Also since the invention is highly expressed in one of the lung cancer cell lines (Lung cancer NCI-H522), it may be useful in diagnosis and treatment of this cancer.

NOV7 is homologous to the Wnt-15-like family of proteins. Thus NOV7 nucleic acids, polypeptides, antibodies and related compounds according to the invention will be useful in Von Hippel-Lindau (VHL) syndrome, Alzheimer's disease, stroke, tuberous sclerosis, hypercalceimia, Parkinson's disease, Huntington's disease, cerebral palsy, epilepsy, Lesch-Nyhan syndrome, multiple sclerosis, ataxia-telangiectasia, leukodystrophies, behavioral disorders, addiction, anxiety, pain, neurodegeneration, cancer, developmental defects, and/or other pathologies/disorders.

NOV8 is homologous to members of the Wnt-14-like family of proteins. Thus, the NOV8 nucleic acids, polypeptides, antibodies and related compounds according to the invention will be useful in therapeutic and diagnostic applications implicated in, for example; Von Hippel-Lindau (VHL) syndrome, Alzheimer's disease, stroke, tuberous sclerosis, hypercalceimia, Parkinson's disease, Huntington's disease, cerebral palsy, epilepsy, Lesch-Nyhan syndrome, multiple sclerosis, ataxia-telangiectasia, leukodystrophies, behavioral disorders, addiction, anxiety, pain, neurodegeneration, cancer, developmental defects, and/or other pathologies/disorders.

NOV9 is homologous to the beta adrenergic receptor kinase-like family of proteins. Thus, NOV9 nucleic acids and polypeptides, antibodies and related compounds according to the invention will be useful in therapeutic and diagnostic applications implicated in, for example: heart failure, hypertension, secondary pathologies caused by heart failure and hypertension, and other diseases, disorders and conditions of the like. Additionally, the compositions of the present invention may have efficacy for treatment of patients suffering from conditions associated with the role of GRK2 in brain and in the regulation of chemokine receptors.

NOV10 is homologous to the alpha-mannosidase-like family of proteins. Thus, NOV10 nucleic acids and polypeptides, antibodies and related compounds according to the invention will be useful in therapeutic and diagnostic applications implicated in, for example: alpha-mannosidosis, beta-mannosidosis, other storage disorders, peroxisomal disorders such as zellweger syndrome, infantile refsum disease, rhizomelic chondrodysplasia (chondrodysplasia punctata, rhizomelic), and hyperpipecolic acidemia and other diseases, disorders and conditions of the like, and/or other pathologies/disorders.

NOV11 is homologous to the C1q-related factor-like family of proteins. Thus, NOV11 nucleic acids and polypeptides, antibodies and related compounds according to the invention will be useful in therapeutic and diagnostic applications implicated in, for example: Th1 inflammatory diseases such as rheumatoid arthritis, multiple sclerosis, inflammatory bowel diseases and psoriasis, lupus erythematosus and glomerulonephritis, control of growh and development/differentiation related functions such as but not limited maturation, lactation and puberty, osteoporosis, obesity, aging and reproductive malfunction and hence could be used in treatment and/or diagnosis of these disorders.

NOV12 is homologous to the Plexin-1 like family of proteins. Thus, NOV12 nucleic acids and polypeptides, antibodies, and related compounds according to the invention will be useful in therapeutic and diagnostic applications implicated in, for example: AIDS, cancer therapy, treatment of Neurologic diseases, Brain and/or autoimmune disorders like encephalomyelitis, neurodegenerative disorders, Alzheimer's Disease, Parkinson's Disorder, immune disorders, and hematopoietic disorders, endocrine diseases, muscle disorders, inflammation and wound repair, bacterial, fungal, protozoal and viral infections (particularly infections caused by HIV-1 or HIV-2), pain, cancer (including but not limited to Neoplasm; adenocarcinoma; lymphoma; prostate cancer; uterus cancer), anorexia, bulimia, asthma, Parkinson's disease, acute heart failure, hypotension, hypertension, urinary retention, osteoporosis, Crohn's disease; multiple sclerosis; and Treatment of Albright Hereditary Ostoeodystrophy, angina pectoris, myocardial infarction, ulcers, asthma, allergies, benign prostatic hypertrophy, and psychotic and neurological disorders, including anxiety, schizophrenia, manic depression, delirium, dementia, severe mental retardation and dyskinesias, such as Huntington's disease or Gilles de la Tourette syndrome, and/or other pathologies/disorders.

The NOVX nucleic acids and polypeptides can also be used to screen for molecules, which inhibit or enhance NOVX activity or function. Specifically, the nucleic acids and polypeptides according to the invention may be used as targets for the identification of small molecules that modulate or inhibit, e.g., neurogenesis, cell differentiation, cell proliferation, hematopoiesis, wound healing and angiogenesis.

Additional utilities for the NOVX nucleic acids and polypeptides according to the invention are disclosed herein.

NOV1

NOV1 includes three novel transmembrane receptor UNC5H2-like proteins disclosed below. The disclosed sequences have been named NOV1a and NOV1b.

NOV1a

A disclosed NOV1 a nucleic acid of 2860 nucleotides (also referred to as GMba58o1__A__da1) encoding a transmembrane receptor UNC5H2-like protein is shown in Table 1A. An open reading frame was identified beginning with an ATG initiation codon at nucleotides 59–61 and ending with a TGA codon at nucleotides 2858–2860. A putative untranslated region upstream from the initiation codon and downstream from the termination codon is underlined in Table 1A. The start and stop codons are in bold letters.

TABLE 1A

NOV1a nucleotide sequence.

(SEQ ID NO:1)
AGACTGGGGCCAGGGAGACAGCCCTGGGGGAGAGGCGCCCGAACCAGGCCGCGGGAGCATGGGGGCCCGGAG

CGGAGCTCGGGGCGCGCTGCTGCTGGCACTGCTGCTCTGCTGGGACCCGAGGCTGAGCCAAGCAGGCACTGA

TTCTGGCAGCGAGGTGCTCCCTGACTCCTTCCCGTCAGCGCCAGCAGAGCCGCTGCCCTACTTCCTGCAGGA

GCCACAGGACGCCTACATTGTGAAGAACAAGCCTGTGGAGCTCCGCTGCCGCGCCTTCCCCGCCACACAGAT

CTACTTCAAGTGCAACGGCGAGTGGGTCAGCCAGAACGACCACGTCACACAGGAAGGCCTGGATGAGGCCAC

CGGTCTGCGGGTGCGCGAGGTGCAGATCGAGGTGTCGCGGCAGCAGGTGGAGGAGCTCTTTGGGCTGGAGGA

TTACTGGTGCCAGTGCGTGGCCTGGAGCTCCGCGGGCACCACCAAGAGTCGCCGAGCCTACGTCCGCATCGC

CTACCTGCGCAAGAACTTCGATCAGGAGCCTCTGGGCAAGGAGGTGCCCCTGGACCATGAGGTTCTCCTGCA

GTGCCGCCCGCCGGAGGGGTGCCTGTGGCCGAGGTGGAATGGCTCAAGAATGAGGATGTCATCGACCCCAC

CCAGGACACCAACTTCCTGCTCACCATCGACCACAACCTCATCATCCGCCAGGCCCGCCTGTCGGACACTGC

CAACTATACCTGCGTGGCCAAGAACATCGTGGCCAAACGCCGGAGCACCACTGCCACCGTCATCGTCTACGT

GAATGGCGGCTGGTCCAGCTGGGCAGAGTGGTCACCCTGCTCCAACCGCTGTGGCCGAGGCTGGCAGAAGCG

CACCCGGACCTGCACCAACCCCGCTCCACTCAACGCGAGGGGCCTTCTGCGAGGGCCAGGCATTCCAGAAGAC

CGCCTGCACCACCATCTGCCCAGTCGATGGGCGTGGACGGAGTGGAGCAAGTGGTCAGCCTGCAGCACTGA

GTGTGCCCACTGGCGTAGCCGCGAGTGCATGGCGCCCCCACCCCAGAACGGAGGCCGTGACTGCAGCGGGAC

GCTGCTCGACTCTAAGAACTGCACAGATGGGCTGTGCATGCAACTGGAGGCCTCAGGGGATGCGGCGCTGTA

TGCGGGGCTCGTGGTGGCCATCTTCGTGGTCGTGGCAATCCTCATGGCGGTGGGGGTGGTGGTGTACCGCCG

CAACTGCCGTGACTTCGACACAGACATCACTGACTCATCTGCTGCCCTGACTGGTGGTTTCCACCCCGTCAA

CTTTAAGACGGCAAGGCCCAGTAACCCGCAGCTCCTACACCCCTCTGTGCCTCCTGACCTGACAGCCAGCGC

CGGCATCTACCGCGGACCCGTGTATGCCCTGCAGGACTCCACCGACAAAATCCCCATGACCAACTCTCCTCT

GCTGGACCCCTTACCCAGCCTTAAGGTCAAGGTCTACAGCTCCAGCACCACGGGCTCTGGGCCAGGCCTGGC

AGATGGGGCTGACCTGCTGGGGGTCTTGCCGCCTGGCACATACCCTAGCGATTTCGCCCGGGACACCCACTT

CCTGCACCTGCGCAGCGCCAGCCTCGGTTCCCAGCAGCTCTTGGGCCTGCCCCGAGACCCAGGGAGCAGCGT

CAGCGGCACCTTTGGCTGCCTGGGTGGGAGGCTCAGCATCCCCGGCACAGGGGTCAGCTTGCTGGTGCCCAA

TGGAGCCATTCCCCAGGGCAAGTTCTACGAGATGTATCTACTCATCAACAAGGCAGAAAGTACCCTGCCGCT

TTCAGAAGGGACCCAGACAGTATTGAGCCCCTCGGTGACCTGTGGACCCACAGGCCTCCTGCTGTGCCGCCC

CGTCATCCTCACCATGCCCCACTGTGCCGAAGTCAGTGCCCGTGACTGGATCTTTCAGCTCAAGACCCAGGC

CCACCAGGGCCACTGGGAGGAGGTGGTGACCCTGGATGAGGAGACCCTGAACACACCCTGCTACTGCCAGCT

GGAGCCCAGGGCCTGTCACATCCTGCTGGACCAGCTGGGCACCTACGTGTTCACGGGCGAGTCCTATTCCCG

TABLE 1A-continued

NOV1a nucleotide sequence.

```
CTCAGCAGTCAAGCGGCTCCAGCTGGCCGTCTTCGCCCCCGCCCTCTGCACCTCCCTGGAGTACAGCCTCCG

GGTCTACTGCCTGGAGGACACGCCTGTAGCACTGAAGGAGGTGCTGGAGCTGGAGCGGACTCTGGGCGGATA

CTTGGTGGAGGAGCCGAAACCGCTAATGTTCAAGGACAGTTACCACAACCTGCGCCTCTCCCTCCATGACCT

CCCCCATGCCCATTGGAGGAGCAAGCTGCTGGCCAAATACCAGGAGATCCCCTTCTATCACATTTGGAGTGG

CAGCCAGAAGGCCCTCCACTGCACTTTCACCCTGGAGAGGCACAGCTTGGCCTCCACAGAGCTCACCTGCAA

GATCTGCGTGCGGCAAGTGGAAGGGGAGGGCCAGATATTCCAGCTGCATACCACTCTGGCAGAGACACCTGC

TGGCTCCCTGGACACTCTCTGCTCTGCCCCTGGCAGCACTGTCACCACCCAGCTGGGACCTTATGCCTTCAA

GATCCCACTGTCCATCCGCCAGAAGATATGCAACAGCCTAGATGCCCCCAACTCACGGGGCAATGACTGGCG

GATGTTAGCACAGAAGCTCTCTATGGACCGGTACCTGAATTACTTTGCCACCAAAGCGAGCCCCACGGGTGT

GATCCTGGACCTCTGGGAAGCTCTGCAGCAGGACGATGGGGACCTCAACAGCCTGGCGAGTGCCTTGGAGGA

GATGGGCAAGAGTGAGATGCTGGTGGCTGTGGCCACCGACGGGGACTGCTGA
```

In a search of public sequence databases, the NOV1a nucleic acid sequence, located on chromsome 10 has 1604 of 1895 bases (84%) identical to a transmembrane receptor UNC5H2 mRNA from *Rattus Norvegicus*, (GENBANK-ID: RNU87306). Public nucleotide databases include all GenBank databases and the GeneSeq patent database.

In all BLAST alignments herein, the "E-value" or "Expect" value is a numeric indication of the probability that the aligned sequences could have achieved their similarity to the BLAST query sequence by chance alone, within the database that was searched. For example, the probability that the subject ("Sbjct") retrieved from the NOV1a BLAST analysis, e.g., transmembrane receptor UNC5H2 mRNA from *Rattus Norvegicus*, matched the Query NOV1a sequence purely by chance is 0.0. The Expect value (E) is a parameter that describes the number of hits one can "expect" to see just by chance when searching a database of a particular size. It decreases exponentially with the Score (S) that is assigned to a match between two sequences. Essentially, the E value describes the random background noise that exists for matches between sequences.

The Expect value is used as a convenient way to create a significance threshold for reporting results. The default value used for blasting is typically set to 0.0001. In BLAST 2.0, the Expect value is also used instead of the P value (probability) to report the significance of matches. For example, an E value of one assigned to a hit can be interpreted as meaning that in a database of the current size one might expect to see one match with a similar score simply by chance. An E value of zero means that one would not expect to see any matches with a similar score simply by chance. See, e.g., http://www.ncbi.nlm.nih.gov/Education/BLASTinfo/. Occasionally, a string of X's or N's will result from a BLAST search. This is a result of automatic filtering of the query for low-complexity sequence that is performed to prevent artifactual hits. The filter substitutes any low-complexity sequence that it finds with the letter "N" in nucleotide sequence (e.g., "NNNNNNNNNNNNNN") or the letter "X" in protein sequences (e.g., "XXXXXXXXX"). Low-complexity regions can result in high scores that reflect compositional bias rather than significant position-by-position alignment. (Wootton and Federhen, *Methods Enzymol* 266:554–571, 1996).

The disclosed NOV1 a polypeptide (SEQ ID NO:2) encoded by SEQ ID NO:1 has 933 amino acid residues and is presented in Table 1B using the one-letter amino acid code. Signal P, Psort and/or Hydropathy results predict that NOV1a has a signal peptide at the first 26 amino acids and is likely to be localized at the plasma membrane with a certainty of 0.5140. In other embodiments, NOV1a is likely to be localized to the microbody (peroxisome) with a certainty of 0.1064, to the endoplasmic reticulum (membrane) with a certainty of 0.1000, or to the endoplasmic reticulum (lumen) with a certainty of 0.1000. The most likely cleavage site for NOV1a is between positions 26 and 27: SQA-GT

TABLE 1B

Encoded NOV1a protein sequence.

(SEQ ID NO:2)

```
MGARSGARGALLLALLLCWDPRLSQAGTDSGSEVLPDSFPSAPAEPLPYFLQEPQDAYIVKNKPVELRCRAF

PATQIYFKCNGEWVSQNDHVTQEGLDEATGLRVREVQIEVSRQQVEELFGLEDYWCQCVAWSSAGTTKSRRA

YVRIAYLRKNFDQEPLGKEVPLDHEVLLQCRPPEGVPVAEVEWLKNEDVIDPTQDTNFLLTIDHNLIIRQAR

LSDTANYTCVAKNIVAKRRSTTATVIVYVNGGWSSWAEWSPCSNRCGRGWQKRTRTCTNPAPLNGGAFCEGQ

AFQKTACTTICPVDGAWTEWSKWSACSTECAHWRSRECMAPPPQNGGRDCSGTLLDSKNCTDGLCMQLEASG
```

TABLE 1B-continued

Encoded NOV1a protein sequence.

DAALYAGLVVAIFVVVAILMAVGVVVYRRNCRDFDTDITDSSAALTGGFHPVNFKTARPSNPQLLHPSVPPD

LTASAGIYRGPVYALQDSTDKIPMTNSPLLDPLPSLKVKVYSSSTTGSGPGLADGADLLGVLPPGTYPSDFA

RDTHFLHLRSASLGSQQLLGLPRDPGSSVSGTFGCLGGRLSIPGTGVSLLVPNGAIPQGKFYEMYLLINKAE

STLPLSEGTQTVLSPSVTCGPTGLLLCRPVILTMPHCAEVSARDWIFQLKTQAHQGHWEEVVTLDEETLNTP

CYCQLEPRACHILLDQLGTYVFTGESYSRSAVKRLQLAVFAPALCTSLEYSLRVYCLEDTPVALKEVLELER

TLGGYLVEEPKPLMFKDSYHNLRLSLHDLPHAHWRSKLLAKYQEIPFYHIWSGSQKALHCTFTLERHSLAST

ELTCKICVRQVECEGQIFQLHTTLAETPAGSLDTLCSAPGSTVTTQLGPYAFKIPLSIRQKICNSLDAPNSR

GNDWRMLAQKLSMDRYLNYFATKASPTGVILDLWEALQQDDGDLNSLASALEEMGKSEMLVAVATDGDC

A search of sequence databases reveals that the NOV1a amino acid sequence has 862 of 945 amino acid residues (91%) identical to, and 897 of 945 amino acid residues (94%) similar to, the 945 amino acid residue 6330415E02RIK protein from *Mus musculus* (Q9D398) (E=0.0). Public amino acid databases include the GenBank databases, SwissProt, PDB and PIR.

NOV1a is at least expressed in endothelial cells, heart, kidney, adipose, brain (hippocampus), brain (thalamus), cerebral cortex, and the following cancer cell lines: breast cancer, CNS cancer, colon cancer, gastric cancer, lung cancer, melanoma, ovarian cancer and pancreatic cancer at a measurably higher level than the following tissues: adrenal gland, bladder, bone barrow, brain (amygdala), brain (cerebellum), brain (whole), breast, colorectal, liver, lung, lymph nod, mammary gland, ovary, pancreas, pituitary gland, placenta, prostate, salivary gland, skeletal muscle, small intestine, spinal cord, spleen, stomach, testis, thymus, thyroid gland, trachea, and uterus.

NOV1b

A disclosed NOV1b nucleic acid of 2860 nucleotides (also referred to as CG50126-02) encoding a novel beta-adrenergic receptor kinase-like protein is shown in Table 1C. An open reading frame was identified beginning with an ATG codon at nucleotides 59–61, and ending with a TGA codon at nucleotides 2858–2860. Putative untranslated regions, if any, are located upstream from the initiation codon and downstream from the termination codon.

TABLE 1C

NOV1b nucleotide sequence.

(SEQ ID NO:3)

AGACTGGGGCCAGGGAGACAGCCCTGGGGGAGAGGCGCCCGAACCAGGCCGCGGGAACATGGGGGCCCGGAGCGGAGCTC

GGGGCGCGCTGCTGCTGGCACTGCTGCTCTGCTGGGACCCGAGGCTGAGCCAAGCAGGCACTGATTCTGGCAGCGAGGTG

CTCCCTGACTCCTTCCCGTCAGCGCCAGCAGAGCCGCTGCCCTACTTCCTGCAGGAGCCACAGGACGCCTACATTGTGAA

GAACAAGCCTGTGGAGCTTCGCTGCCGCGCCTTCCCCGCCACACAGATCTACTTCAAGTGCAACGGCGAGTGGGTCAGCC

AGAACGACCACGTCACACAGGAAGGCCTGGATGAGGCCACCGGCCTGCGGGTGCGCGAGGTGCAGATCGAGGTGTCGCGG

CAGCAGGTGGAGGAGCTCTTTGGGCTGGAGGATTACTGGTGCCAGTGCGTGGCCTGGAGCTCCGCAGGCACCACCAAGAG

TCGCCGAGCCTACGTCCGCATCGCCTACCTGCGCAAGAACTTCGATCAGGAGCCTCTGGGCAAGGAGGTGCCCCTGGACC

ATGAGGTTCTCCTGCAGTGCCGCCCGCCGGAGGGGGTGCCTGTGGCCGAGGTGGAATGGCTCAAGAATGAGGATGTCATC

GACCCCACCCAGGACACCAACTTCCTGCTCACCATCGACCACAACCTCATCATCCGCCAGGCCCGCCTGTCGGACACTGC

CAACTATACCTGCGTGGCCAAGAACATCGTGGCCAAACGCCGGAGCACCACTGCCACCGTCATCGTCTACGTGAATGGCG

GCTGGTCCAGCTGGGCAGAGTGGTCACCCTGCTCCAACCGCTGTGGCCGAGGCTGGCAGAAGCGCACCCGGACCTGCACC

AACCCCGCTCCACTCAACGGAGGGGCCTTCTGCGAGGGCCAGGCATTCCAGAAGACCGCCTGCACCACCATCTGCCCAGT

CGATGGGGCGTGGACGGAGTGGAGCAAGTGGTCAGCCTGCAGCACTGAGTGTGCCCACTGGCGTAGCCGCGAGTGCATGG

CGCCCCCACCCCAGAACGGAGGCCGTGACTGCAGCGGGACGCTGCTCGACTCTAAGAACTGCACAGATGGGCTGTGCATG

CAACTGGAGGCCTCAGGGGATGCGGCGCTGTATGCGGGGCTCGTGGTGGCCATCTTCGTGGTCGTGGCAATCCTCATGGC

GGTGGGGGTGGTGGTGTACCGCCGCAACTGCCGTGACTTCGACACAGACATCACTGACTCATCTGCTGCCCTGACTGGTG

GTTTCCACCCCGTCAACTTTAAGACGGCAAGGCCCAGTAACCCGCAGCTCCTACACCCCTCTGTGCCTCCTGACCTGACA

TABLE 1C-continued

NOV1b nucleotide sequence.

```
GCCAGCGCCGGCATCTACCGCGGACCCGTGTATGCCCTGCAGGACTCCACCGACAAAATCCCCATGACCAACTCTCCTCT
GCTGGACCCCTTACCCAGCCTTAAGGTCAAGGTCTACAGCTCCAGCACCACGGGCTCTGGGCCAGGCCTGGCAGATGGGG
CTGACCTGCTGGGGGTCTTGCCGCCTGGCACATACCCTAGCGATTTCGCCCGGGACACCCACTTCCTGCACCTGCGCAGC
GCCAGCCTCGGTTCCCAGCAGCTCTTGGGCCTGCCCCGAGACCCAGGGAGCAGCGTCAGCGGCACCTTTGGCTGCCTGGG
TGGGAGGCTCAGCATCCCCGGCACAGGGGTCAGCTTGCTGGTGCCCAATGGAGCCATTCCCCAGGGCAAGTTCTACGAGA
TGTATCTACTCATCAACAAGGCAGAAAGTACCCTGCCGCTTTCAGAAGGGACCCAGACAGTATTGAGCCCCTCGGTGACC
TGTGGACCCACAGGCCTCCTGCTGTGCCGCCCCGTCATCCTCACCATGCCCCACTGTGCCGAAGTCAGTGCCCGTGACTG
GATCTTTCAGCTCAAGACCCAGGCCCACCAGGGCCACTGGGAGGAGGTGGTGACCCTGGATGAGGAGACCCTGAACACAC
CCTGCTACTGCCAGCTGGAGCCCAGGGCCTGTCACATCCTGCTGGACCAGCTGGGCACCTACGTGTTCACGGGCGAGTCC
TATTCCCGCTCAGCAGTCAAGCGGCTCCAGCTGGCCGTCTTCGCCCCCGCCCTCTGCACCTCCCTGGAGTACAGCCTCCG
GGTCTACTGCCTGGAGGACACGCCTGTAGCACTGAAGGAGGTGCTGGAGCTGGAGCGGACTCTGGGCGGATACTTGGTGG
AGGAGCCGAAACCGCTAATGTTCAAGGACAGTTACCACAACCTGCGCCTCTCCCTCCATGACCTCCCCCATGCCCATTGG
AGGAGCAAGCTGCTGGCCAAATACCAGGAGATCCCCTTCTATCACATTTGGAGTGGCAGCCAGAAGGCCCTCCACTGCAC
TTTCACCCTGGAGAGGCACAGCTTGGCCTCCACAGAGCTCACCTGCAAGATCTGCGTGCGGCAAGTGGAAGGGGAGGGCC
AGATATTCCAGCTGCATACCACTCTGGCAGAGACACCTGCTGGCTCCCTGGACACTCTCTGCTCTGCCCCTGGCAGCACT
GTCACCACCCAGCTGGGACCTTATGCCTTCAAGATCCCACTGTCCATCCGCCAGAAGATATGCAACAGCCTAGATGCCCC
CAACTCACGGGGCAATGACTGGCGGATGTTAGCACAGAAGCTCTCTATGGACCGGTACCTGAATTACTTTGCCACCAAAG
CGAGCCCCACGGGTGTGATCCTGGACCTCTGGGAAGCTCTGCAGCAGGACGATGGGGACCTCAACAGCCTGGCGAGTGCC
TTGGAGGAGATGGGCAAGAGTGAGATGCTGGTGGCTGTGGCCACCGACGGGGACTGCTGA
```

In a search of public sequence databases, the NOV1b nucleic acid sequence, located on chromsome 10 has 1604 of 1895 bases (84%) identical to a gb:GENBANK-ID:RNU87306|acc:U87306.1 mRNA from *Rattus norvegicus* (*Rattus norvegicus* transmembrane receptor Unc5H2 mRNA, complete cds). (E=0.0) Public nucleotide databases include all GenBank databases and the GeneSeq patent database.

The disclosed NOV1b polypeptide (SEQ ID NO:4) encoded by SEQ ID NO:3 has 933 amino acid residues and is presented in Table 1D using the one-letter amino acid code. Signal P, Psort and/or Hydropathy results predict that NOV1b has a signal peptide at the first 26 amino acids and is likely to be localized at the plasma membrane with a certainty of 0.5140. In other embodiments, NOV1b is likely to be localized to the microbody (peroxisome) with a certainty of 0.1064, to the endoplasmic reticulum (membrane) with a certainty of 0.1000, or to the endoplasmic reticulum (lumen) with a certainty of 0.1000. The most likely cleavage site for NOV1b is between positions 26 and 27: SQA-GT

TABLE 1D

Encoded NOV1b protein sequence.

(SEQ ID NO:4)

```
MGARSGARGALLLALLLCWDPRLSQAGTDSGSEVLPDSFPSAPAEPLPYFLQEPQDAYIVKNKPVELRCRAFPATQIYFK
CNGEWVSQNDHVTQEGLDEATGLRVREVQIEVSRQQVEELFGLEDYWCQCVAWSSAGTTKSRRAYVRIAYLRKNFDQEPL
GKEVPLDHEVLLQCRPPEGVPVAEVEWLKNEDVIDPTQDTNFLLTIDHNLIIRQARLSDTANYTCVAKNIVAKRRSTTAT
VIVYVNGGWSSWAEWSPCSNRCGRGWQKRTRTCTNPAPLNGGAFCEGQAFQKTACTTICPVDGAWTEWSKWSACSTECAH
WRSRECMAPPPQNGGRDCSGTLLDSKNCTDGLCMQLEASGDAALYAGLVVAIFVVVAILMAVGVVVYRRNCRDFDTDITD
SSAALTGGFHPVNFKTARPSNPQLLHPSVPPDLTASAGIYRGPVYALQDSTDKIPMTNSPLLDPLPSLKVKVYSSSTTGS
GPGLADGADLLGVLPPGTYPSDFARDTHFLHLRSASLGSQQLLGLPRDPGSSVSGTFGCLGGRLSIPGTGVSLLVPNGAI
PQGKFYEMYLLINKAESTLPLSEGTQTVLSPSVTCGPTGLLLCRPVILTMPHCAEVSARDWIFQLKTQAHQGHWEEVVTL
```

TABLE 1D-continued

Encoded NOV1b protein sequence.

DEETLNTPCYCQLEPRACHILLDQLGTYVFTGESYSRSAVKRLQLAVFAPALCTSLEYSLRVYCLEDTPVALKEVLELER

TLGGYLVEEPKPLMFKDSYHNLRLSLHDLPHAHWRSKLLAKYQEIPFYHIWSGSQKALHCTFTLERHSLASTELTCKICV

RQVEGEGQIFQLHTTLAETPAGSLDTLCSAPGSTVTTQLGPYAFKIPLSIRQKICNSLDAPNSRGNDWRMLAQKLSMDRY

LNYFATKASPTGVILDLWEALQQDDGDLNSLASALEEMGKSEMLVAVATDGDC

A search of sequence databases reveals that the NOV1b amino acid sequence has 862 of 945 amino acid residues (91%) identical to, and 893 of 945 amino acid residues (94%) similar to, the 945 amino acid residue ptnr:SPTREMBL-ACC:008722 protein from *Rattus norvegicus* (Rat) (Transmembrane Receptor UNC5H2) (E=0.0). Public amino acid databases include the GenBank databases, SwissProt, PDB and PIR.

NOV1b is expressed in at least adrenal gland, bone marrow, brain—amygdala, brain—cerebellum, brain—hippocampus, brain—substantia nigra, brain—thalamus, brain—whole, fetal brain, fetal kidney, fetal liver, fetal lung, heart, kidney, lymphoma—Raji, mammary gland, pancreas, pituitary gland, placenta, prostate, salivary gland, skeletal muscle, small intestine, spinal cord, spleen, stomach, testis, thyroid, trachea, uterus. This information was derived by determining the tissue sources of the sequences that were included in the invention including but not limited to SeqCalling sources, Public EST sources, and/or RACE sources.

The disclosed NOV1a polypeptide has homology to the amino acid sequences shown in the BLASTP data listed in Table 1E.

TABLE 1E

BLAST results for NOV1a

| Gene Index/ Identifier | Protein/Organism | Length (aa) | Identity (%) | Positives (%) | Expect |
|---|---|---|---|---|---|
| ptnr: SPTREMBL-ACC: Q9D398 | 6330415E02RIK PROTEIN - *Mus musculus* (Mouse) | 945 | 862/945 (91%) | 897/945 (94%) | 0.0 |
| ptnr: SPTREMBL-ACC: O08722 | TRANSMEMBRANE RECEPTOR UNC5H2 | 945 | 862/945 (91%) | 893/945 (94%) | 0.0 |
| ptnr: SPTREMBL-ACC: O08747 | UNC-5 HOMOLOG (*C. ELEGANS*) | 931 | 610/929 (65%) | 723/929 (77%) | 0.0 |
| ptnr: SPTREMBL-ACC: O95185 | TRANSMEMBRANE RECEPTOR UNC5C - *Homo sapiens* | 931 | 598/929 (64%) | 718/929 (77%) | 0.0 |

The homology between these and other sequences is shown graphically in the ClustalW analysis shown in Table 1F. In the ClustalW alignment of the NOV1 proteins, as well as all other ClustalW analyses herein, the black outlined amino acid residues indicate regions of conserved sequence (i.e., regions that may be required to preserve structural or functional properties), whereas non-highlighted amino acid residues are less conserved and can potentially be altered to a much broader extent without altering protein structure or function.

TABLE 1F

ClustalW Analysis of NOV1

1) NOV1a (SEQ ID NO:2)
2) NOV1b (SEQ ID NO:4)
3) ptnr: 6330415E02RIK PROTEIN - Mus musculus (Mouse) (SEQ ID NO:33)
4) ptnr: TRANSMEMBRANE RECEPTOR UNC5H2 (SEQ ID NO:34)
5) ptnr: UNC-5 HOMOLOG (*C. ELEGANS*) (SEQ ID NO:35)
6) ptnr: TRANSMEMBRANE RECEPTOR UNC5C - *Homo sapiens* (SEQ ID NO:36)

TABLE 1F-continued

ClustalW Analysis of NOV1

```
NOV1a    -------MGARSCA-RGALLLALLLCEDPRLSQAGTDSGSE------VLPDSFPSAPAEPLPYFIQEPCDAYIVKNKPVE  66
NOV1b    -------MGARSCA-RGALLLALLLCEDPRLSQAGTDSGSE------VLPDSFPSAPAEPLPYFIQEPCDAYIVKNKPVE  66
Q9D398   -------MRARSCV-RSALLLALLLCEDPTPSLAGVDSAGQ------VLPDSYSAPAEQLPYFILEPCDAYIVKNKPVE  66
O08722   -------MRARSCA-RGALLLALLLCEDPTPSLAGIDSGGQ------ALPDSFPSAPAEQLPHFILEPCDAYIVKNKPVE  66
O08747   MRKGLRATAAPCCLGLGYLLQMLVLPALALLSASCTGSAAQDDEFFHELPETFPSDPPEPLPHFIIEEKHAYIVKNKPVN  80
O95185   MRKGLRATAAPCCLGLGYLLQMLVLPALALLSASCTGSAAQDDDFFHELPSTFPSDPPEPLPHFIIEEKHAYIVKNKPVN  80

NOV1a    IRCRAFPATQIYFKCNGEWVSCNDHVTQEGLDEATGLRVPEVQIEVSRQQVEELFGLEDYWCQCVAWSSAGTTKSRRAYV  146
NOV1b    IRCRAFPATQIYFKCNGEWVSCNDHVTQEGLDEATGLRVREVQIEVSRQQVEELFGLEDYWCQCVAWSSAGTTKSRRAYV  146
Q9D398   IHCRAFPATQIYFKCNGEWVSCNDHVTQESLDEATGLRIREVQIEVSRQQVEELFGLEDYWCQCVAWSSGTTKSRRAYI  146
O08722   IHCRAFPATQIYFKCNGEWVSQKGHVTQESLDEATGLRIREVQIEVSRQQVEELFGLEDYWCQCVAWSSSGTTKSRRAYI  146
O08747   IYCKASPATQIYFKCNSEWVHQKDHVVDPRVDETSGLIVREVSIEKSRQQVEELFGPEDYWCQCVAWSSAGTTKSRKAYV  160
O95185   IYCKASPATQIYFKCNSEWVHQKDHIVDERVDETSGLIVREVSIEKSRQQVEELFGPEDYWCQCVAWSSAGTTKSRKAYV  160

NOV1a    RIAYLRKNFDQEPLGKEVPLDHEVLLQCRPPEGVPVAEVEWLKNEDVIDETQDINFLLTIDHNLIIRQARLSDTANYTCV  226
NOV1b    RIAYLRKNFDQEPLGKEVPLDHEVLLQCRPPEGVPVAEVEWLKNEDVIDETQDINFLLTIDHNLIIRQARLSDTANYTCV  226
Q9D398   RIAYLRKNFDQEPLAKEVPLDHEVLLQCRPPEGVPVAEVEWLKNEDVIDEAQDINFLLTIDHNLIIRQARLSDTANYTCV  226
O08722   RIAYLRKNFDQEPLAKEVPLDHEVLLQCRPPEGVPVAEVEWLKNEDVIDEAQDINFLLTIDHNLIIRQARLSDTANYTCV  226
O08747   RIAYLRKTFEQEPLGKEVSLEQEVLLQCRPPEGSPVAEVEWLKNEDIIDEAHDRNFYITIDHNLIIKQARLSDTANYTCV  240
O95185   RIAYLRKTFEQEPLGKEVSLEQEVLLQCRPPEGSPVAEVEWLKNEDLIDEVHDRNFYITIDHNLIIKQARLSDTANYTCV  240

NOV1a    AKNIVAKRRSTTATVIVYVNGGWSSWAEWSPCSNRCGRGWQKRTRTCTNPAPLNGGAFCEGQAFQKTACTTICPVDGAWT  306
NOV1b    AKNIVAKRRSTTATVIVYVNGGWSSWAEWSPCSNRCGRGWQKRTRTCTNPAPLNGGAFCEGQAFQKTACTTICPVDGAWT  306
Q9D398   AKNIVAKRRSTAATVIVYVNGGWSSWAEWSPCSNRCGRGWQKRTRTCTNPAPLNGGAFCEGQAFQKTACTTVCPVDGAWT  306
O08722   AKNIVAKRRSTTATVIVYVNGGWSSWAEWSPCSNRCGRGWQKRTRTCTNPAPLNGGAFCEGQACQKTACTTVCPVDGAWT  306
O08747   AKNIVAKRKSTTATVIVYVNGGWSPTEWSVCNSRCGRGEQKRTRTCTNPAPLNGGAFCEGQEVQKIACTTKCPVDGRWT  320
O95185   AKNIVAKRKSTTATVIVYVNGGWSPTEWSVCNSRCGRGEQKRTRTCTNPAPLNGGAFCEGQEVQKIACTTKCPVDGRWT  320

NOV1a    EWSKWSACSTECAHWRSRECMAPPPQNGGRDCSGTLLDSKNCTDGLCMQ------------LEASGDAALYAGLVVAIFV  374
NOV1b    EWSKWSACSTECAHWRSRECMAPPPQNGGRDCSGTLLDSKNCTDGLCMQ------------LEASGDAALYAGLVVAIFV  374
Q9D398   EWSKWSACSTECAHWRSRECMAPPPQNGGRDCSGTLLDSKNCTDGLCVLNQRTLNDPKSHPLETSGDVALYAGLVVAVFV  386
O08722   EWSKWSACSTECAHWRSRECMAPPPQNGGRDCSGTLLDSKNCTDGLCVLNQRTLNDPKSHPLEPSGDVALYAGLVVAVFV  386
O08747   SWSKWSTCGTECTHWRRRECTAEAFKNGGKDCDGLVIQSKNCTDGLCMQA-----------APDSDDVALYVGIVIAVIV  389
O95185   PWSKWSTCGTECTHWRRRECTAEAFKNGGKDCDGLVIQSKNCTDGLCMQT-----------APDSDDVALYVGIVIAVIV  389

NOV1a    VVAILMAVGVWVYRRNCRDFDTDITDSSAALTGGFHPVNFKTARPSNPQLLHPSVPPDLTASAGIYRGPVYALQDSIDKI  454
NOV1b    VVAILMAVGVWVYRRNCRDFDTDITDSSAALTGGFHPVNFKTARPSNPQLLHPSVPPDLTASAGIYRGPVYALQDSIDKI  454
Q9D398   VVAVLMAEGVIVYRRNCRDFDTDITDSSAALTGGFHPVNFKTARPNNPQLLHPSAPPDLTASAGIYRGPVYALQDSADKI  466
O08722   VLAVLMAVGVIVYRRNCRDFDTDITDSSAALTGGFHPVNFKTARPSNPQLLHPSAPPDLTASAGIYRGPVYALQDSADKI  466
O08747   CLAITVVVAPFVYRKNHRDFESDIDS-SALNGGFCPVNIKAAR-QD--L--LAVPPDLTSAAAMYRGPVYALHIVSDKI  463
O95185   CLAITVVVAPFVYRKNHRDFSSDIDS-SALNGGFCPVNIKAAR-QD--L--LAVPPDLTSAAAMYRGPVYALHIVSDKI  463

NOV1a    PMTNSPLLDPLPSLKVKVYSSSTTGSGPGLADGADLLCVLPPGTYPSDFARDTHFLHLRSASLGSCQLLGLPRDEGSSVS  534
NOV1b    PMTNSPLLDPLPSLKVKVYSSSTTGSGPGLADGADLLCVLPPGTYPSDFARDTHFLHLRSASLGSCQLLGLPRDEGSSVS  534
Q9D398   PMTNSPLLDPLPSLKIKVYNSSTIGSGSGLADGADLLCVLPPGTYPGDESRDTHFLHLRSASLGSCHLLGLPRDESSVS  546
O08722   PMTNSPLLDPLPSLKIKVYNSSTIGSGSGLADGADLLCVLPPGTYPGDESRDTHFLHLRSASLGSCHLLGLPRDESSVS  546
O08747   PMTNSPILDPLPNLKIKVYKSS--GAVTPQDDLAEFSSKISLSEQMTQS--LLENEALNIKNQSLARC------TDPSCTAF  533
O95185   PMTNSPILDPLPNLKIKVYNTS--GAVSPQDDLSEFTSKISLSEQMTAS--LLENEALSIKNQSLARC------TDPSCTAF  533

NOV1a    GTFGCLGGRISIPGTGVSLLVENGAIPQGKFYEMYILINKAESTLPLSEGIQTVLSPSVTCGPTGLLLCRPVILTMPHCA  614
NOV1b    GTFGCLGGRISIPGTGVSLLVENGAIPQGKFYEMYILINKAESTLPLSEGIQTVLSPSVTCGPTGLLLCRPVILTMPHCA  614
Q9D398   GTFGCLGGRISLPGTGVSLLVENGAIPQGKFYDLYIHINKAESTLPLSEGSQTVLSPSVTCGPTGLLLCRPVVLTVPHCA  626
O08722   GTFGCLGGRITIPGTGVSLLVENGAIPQGKFYDLYIRINKTESTLPLSEGSQTVLSPSVTCGPTGLLLCRPVVLTVPHCA  626
O08747   GTFNSLGGHIIIPNSGVSLITPAGAIPQGKRVYFMYVTVHRKENMREPMEDSQTEIPVVSCGPPCALLIRPVILTHHCA  613
O95185   GSFNSLGGHIIVPNSGVSLITPAGAIPQGKRVYEMYVTVHRKENMREPMDDSQTLIPVVSCGPPCALLIRPVILTMHHCA  613

NOV1a    EVSARDWIFQLKTQAHQGHWEEVVTLDEETINTPCYCQLPPRACHILLDQLGTYVFTGESYSRSAVKRLQLAVFAPALCT  694
NOV1b    EVSARDWIFQLKTQAHQGHWEEVVTLDEETINTPCYCQLPPRACHILLDQLGTYVFTGESYSRSAVKRLQLAVFAPALCT  694
Q9D398   EVIAGDWIFQLKTQAHQGHWEEVVTLDEETINTPCYCQLEAKSCHILLDQLGSYVFMGESYSRSAVKRLQLAIFAPALCT  706
O08722   EVIAGDWIFQLKTQAHQGHWEEVVTLDEETINTPCYCQLEAKSCHILLDQLGTYVFTGESYSRSAVKRLQLAIFAPALCT  706
O08747   DPSTEDWKIQLKNQAVQGCWEDVVVVGEENFTTPCYIQLDAEEACHILTENISTYALVGQSTTKAAAKRIKLAIFGELCCS  693
O95185   DPNTEDWKIILKNQAAQGCWEDVVVYGEENFTTPCYIKLDAEEACHILTENISTYALVCHSTTKAAAKRIKLAIFGELCCS  693

NOV1a    SLEYSLRVYCLEDTEVALKEVLELERTLGGYLVEEPKPLMFKDSYHNLRLSLHDEPHAWRSKLLAKYQEIPFYHIWSGS  774
NOV1b    SLEYSLRVYCLEDTEVALKEVLELERTLGGYLVEEPKPLMFKDSYHNLRLSLHDEPHAWRSKLLAKYQEIPFYHIWSGS  774
Q9D398   SLEYSLRVYCLEDTEVALKEVLELERTLGGYLVEEPKPLEFKDSYHNLRLSLHDEPHAWRSKLLAKYQEIPFYHVWNGS  786
O08722   SLEYSLRVYCLEDTEAALKEVLELERTLGGYLVEEPKTLEFKDSYHNLRLSLHDEPHAWRSKLLAKYQEIPFYHVWNGS  786
O08747   SLEYSIRVYCIEDIQDALKELHLEROGGCIEEEPKALHFKGSIHNLRLSIHDEAHSLWKSKLLAKYQEIPFYHIWSGS  773
O95185   SLEYSIRVYCIEDTQDALKEITHLEROTGCCIEEEPKALHFKGSTHNLRLSIHDEAHSLWKSKLLAKYQEIPFYHVWSGS  773

NOV1a    QKALHCTFTLERHSLASTELTCKKCVRQVEGEGQIFQLHTTLAETPAGSLDTLCSAPGSTVITTQLGPYAFKIPLSIRQKI  854
NOV1b    QKALHCTFTLERHSLASTELTCKKCVRQVEGEGQIFQLHTTLAETPAGSLDTLCSAPGSTVITTQLGPYAFKIPLSIRQKI  854
Q9D398   QRALHCTFTLERHSLASTEFICKYCVRQVEGEGQIFQLHTTLAETPAGSLDALCSAPGCNAITQLGPYAFKIPLSIRQKI  866
O08722   QKALHCTFTLERHSLASTEFICKYCVRQVEGEGQIFQLHTTLAETPAGSLDALCSAPGNAATQLGPYAFKIPLSIRQKI  866
O08747   QRNLHCTFTLERLSLNTVELVCKLCVRQVEGEGQIFQLNCIVSEEPTC-DLPLLDEASTTTVTGPSAESIPLPIRQKE  852
O95185   QRNLHCTFTLERFSLNTVELVCKLCVRQVEGEGQIFQLNCIVSEEPTC-DLPLLDEANITTVTGPSAESIPLPIRQKE  852
```

TABLE 1F-continued

ClustalW Analysis of NOV1

```
NOV1a   CNSLDAENSRGNDWRMLAQKLSMDRYLNYFATKASPTGVILDLWEALQQDDGDINSLASALEEMGKSEMLVAVATDGDC  854
NOV1b   CNSLDAENSRGNDWRMLAQKLSMDRYLNYFATKASPTGVILDLWEALQQDDGDINSLASALEEMGKSEMLVAVATDGDC  854
Q9D398  CSSLDAEDSRGNDWRILAQKLSMDRYLNYFATKASPTGVILDLWEARQQDDGDINSLASALEEMGKSEMLVAMATDGDC  866
O08722  CNSLDAEDSRGNDWRILAQKLSMDRYLNYFATKASPTGVILDLWEARQQDDGDINSLASALEEMGKSEMLVAMITDGDC  866
O08747  CSSLDAPQIRGHDWRMLAHKLNEDRYLNYFATKSSPTGVILDLWEAQNFEDGNLSMLAAVLEEMGRHETVVSLAAEGQY  852
O95185  CSSLDAPQIRGHDWRMLAHKLNEDRYLNYFATKSSPTGVILDLWEAQNFEDGNLSMLAAVLEEMGRHETVVSLAAEGQY  852
```

The presence of identifiable domains in NOV1, as well as all other NOVX proteins, was determined by searches using software algorithms such as PROSITE, DOMAIN, Blocks, Pfam, ProDomain, and Prints, and then determining the Interpro number by crossing the domain match (or numbers) using the Interpro website (http:www.ebi.ac.uk/interpro). DOMAIN results for NOV1 as disclosed in Tables 1G–1O, were collected from the Conserved Domain Database (CDD) with Reverse Position Specific BLAST analyses. This BLAST analysis software samples domains found in the Smart and Pfam collections. For Tables 1G–1O and all successive DOMAIN sequence alignments, fully conserved single residues are 65 indicated by black shading or by the sign (|) and "strong" semi-conserved residues are indicated by grey shading or by the sign (+). The "strong" group of conserved amino acid residues may be any one of the following groups of amino acids: STA, NEQK, NHQK, NDEQ, QHRK, MILV, MILF, HY, FYW.

Tables 1G–1O list the domain descriptions from DOMAIN analysis results against NOV1a. This indicates that the NOV1a sequence has properties similar to those of other proteins known to contain this domain.

TABLE 1G

Domain Analysis of NOV1a

```
gnl|Smart|smart00218, ZU5, Domain present in ZO-1 and Unc5-like netrin
receptors; Domain of unknown function. (SEQ ID NO:85)
CD-Length = 104 residues, 100.0% aligned
Score = 149 bits (376), Expect = 7e-37

Query:  529  PGSSVSGTFGCLGGRLSIPGTGVSLLVPNGAIPQGKFYEMYLLINKAESTLPLSEGTQTV  588
                 |||||  ||||  | |||  |++| ||||||  |   ||+++  || |  |   +|+
Sbjct:    1  PSFLVSGTFDARGGRLRGPRTGVRLIIPPGAIPQGTRYTCYLVVHDKLSTPPPLEEGETL   60

Query:  589  LSPSVTCGPTGLLLCRPVILTMPHCAEVSARDWIFQLKTQAHQG  632
             |||  |  |||  | |  |||||  +||||  +   |||    |   + |
Sbjct:   61  LSPVVECGPHGALFLRPVILEVPHCASLRPRDWEIVLLRSENGG  104
```

TABLE 1H

Domain Analysis of NOV1a

```
gnl|Pfam|pfam00791, ZU5, ZU5 domain. Domain present in ZO-1 and Unc5-
like netrin receptors Domain of unknown function. (SEQ ID NO:86)
CD-Length = 104 residues, 100.0% aligned
Score = 147 bits (371), Expect = 3e-36

Query:  529  PGSSVSGTFGCLGGRLSIPGTGVSLLVPNGAIPQGKFYEMYLLINKAESTLPLSEGTQTV  588
                 |||||  ||||  | |||  |++| ||||||  |   ||+++  || |  |   +|+
Sbjct:    1  SGFLVSGTFDARGGRLRGPRTGVRLIIPPGAIPQGTRYTCYLVVHDKLSTPPPLEEGETL   60

Query:  589  LSPSVTCGPTGLLLCRPVILTMPHCAEVSARDWIFQLKTQAHQG  632
             |||  |  |||  | |  |||||  +||||  +   |||    |   + |
Sbjct:   61  LSPVVECGPHGALFLRPVILEVPHCASLRPRDWELVLLRSENGG  104
```

TABLE 1I

Domain Analysis of NOV1a

```
gnl|Smart|smart00005, DEATH, DEATH domain, found in proteins involved
in cell death (apoptosis).; Alpha-helical domain present in a variety
of proteins with apoptotic functions. Some (but not all) of these
domains form homotypic and heterotypic dimers. (SEQ ID NO:87)
CD-Length = 96 residues, 99.0% aligned
Score = 64.7 bits (156), Expect = 2e-11

Query:  840  GPYAFKIPLSIRQKICNSLDAPNSRGNDWRMLAQKLSM-DRYLNYFATKAS-----PTGV  893
             | |  +    +|+    ||   + |+||| ||+||  +  ++   |++       +
```

TABLE 1I-continued

Domain Analysis of NOV1a

```
Sbjct:   1 PPGAASLTELTREKLAKLLD--HDLGDDWRELARKLGLSEADIDQIETESPRDLAEQSYQ 58

Query: 894 ILDLWEALQQDDGDLNSLASALEEMGKSEMLVAVATD 930
           +|  |||   +   +   |+|   ||  +||+ + +   + ++
Sbjct:  59 LLRLWEQREGKNATLGTLLEALRKMGRDDAVELLRSE 95
```

TABLE 1J

Domain Analysis of NOV1a gnl|Smart|smart00209, TSP1, Thrombospondin type 1 repeats; Type 1 repeats in thrombospondin-1 bind and activate TGF-beta. (SEQ ID NO:88)
CD-Length = 51 residues, 100.0% aligned
Score = 62.4 bits (150), Expect = 1e-10

```
Query: 249 WSSWAEWSPCSNRCGRGWQKRTRTCTNPAPLNGGAFCEGQAFQKTACTT-ICP 300
           |  |+||||||  || |  |||  |    |||  |  | +  ||    ||
Sbjct:   1 WGEWSEWSPCSVTCGGGVQTRTRCCNPPP--NGGGPCTGPDTETRACNEQPCP 51
```

TABLE 1K

Domain Analysis of NOV1a gnl|Smart|smart00209, TSP1, Thrombospondin type 1 repeats; Type 1 repeats in thrombospondin-1 bind and activate TGP-beta. (SEQ ID NO:88)
CD-Length = 51 residues, 98.0% aligned
Score = 49.3 bits (116), Expect = 1e-06

```
Query: 305 WTEWSKWSACSTECAH-WRSRECMAPPPQNGGRDCSGTLLDSKNCTDGLC 353
           | |||+|| ||  |     ++|    |||| |+|  +++ | + |
Sbjct:   1 WGEWSEWSPCSVTCGGGVQTRTRCCNPPPNGGGPCTGPDTETRACNEQPC 50
```

TABLE 1L

Domain Analysis of NOV1a gnl|Pfam|pfam00531, death, Death domain. (SEQ ID NO:89)
CD-Length = 83 residues, 98.8% aligned
Score = 57.4 bits (137), Expect = 4e-09

```
Query: 852 QKICNSLDAPNSRGNDWRMLAQKLSM-DRYLNYFATKA----SPTGVILDLWEALQQDDG 906
           +++|  ||  |   |||| ||+||  + +  ++   +    |||  +|||||    +
Sbjct:   1 RELCKLLDDP--LGRDWRRLARKLGLSEEEIDQIEHENPRLASPTYQLLDLWEQRGGKNA 58

Query: 907 DLNSLASALEEMGKSEMLVAVATD 930
             + |   || +||+ + +  + +
Sbjct:  59 TVGTLLEALRKMGRDDAVELLESA 82
```

TABLE 1M

Domain Analysis of NOV1a gnl|Pfam|pfam00090, tsp_1, Thrombospondin type 1 domain. (SEQ ID NO: 90)
CD-Length = 48 residues, 91.7% aligned
Score = 49.7 bits (117), Expect = 7e-07

```
Query: 250 SSWAEWSPCSNRCGRGWQKRTRTCTNPAPLNGGAFCEGQAFQKTACT 296
           |  |+||||||   ||+| + |||     +||   |  |  +  ||
Sbjct:   1 SPWSEWSPCSVTCGKGIRTRQRTCNSPA---GGKPCTGDAQETEACM 44
```

TALBE 1N

Domain Analysis of NOV1a

```
gnl|Smart|smart00409, IG, Immunoglobulin (SEQ ID NO:91)
CD-Length = 86 residues, 100.0% aligned
Score = 48.9 bits (115), Expect = 1e-06

Query:  159  PLGKEVPLDHEVLLQCRPPEGVPVAEVEWLKNEDVIDPTQDTNFLLTIDHN---LIIRQA  215
                    |   | | |   | | |   | | |   +    +  |  ++        |  |
Sbjct:    1  PPSVTVKEGESVTLSCEAS-GNPPPTVTWYKQGGKL-LAESGRFSVSRSGGNSTLTISNV  58

Query:  216  RLSDTANYTCVAKNIVAKRRSTTATVIVY  244
             |+  ||| || |        | | |+ |
Sbjct:   59  TPEDSGTYTCAATNSSGSASSGT-TLTVL  86
```

TABLE 1O

Domain Analysis of NOV1a

```
gnl|Smart|smart00408, IGc2, Immunoglobulin C-2 Type (SEQ ID NO:92)
CD-Length = 63 residues, 87.3% aligned
Score = 42.7 bits (99), Expect = 9e-05

Query:  170  VLLQCRPPEGVPVAEVEWLKNEDVIDPTQDTNFLLTIDHNLIIRQARLSDTANYTCVAKN  229
             | | |  | ||  + |||+   +  ++     ++       | |+    | |+ |||||+|
Sbjct:    6  VTLTC-PASGDPVPNITWLKDGKPLPESR----VVASGSTLTIKNVSLEDSGLYTCVARN  60
```

Migration of neurons from proliferative zones to their functional sites is fundamental to the normal development of the central nervous system. Disruption of the mouse rostral cerebellar malformation mutation (rcm) gene, also called the Unc5h3 gene, resulted in a failure of tangentially migrating granule cells to recognize the rostral boundary of the cerebellum. In rcm-mutant mice, the cerebellum is smaller and has fewer folia than in wildtype, ectopic cerebellar cells are present in midbrain regions by 3 days after birth, and there are abnormalities in postnatal cerebellar-neuronal migration. Ackerman et al. (1997). Sequence analysis has revealed that the predicted rcm mouse protein is a transmembrane protein that contains 2 immunoglobulin (Ig)-like domains and 2 type I thrombospondin (THBS1) motifs in the extracellular region. Ig and THBS1 domains are also found in the extracellular region of the C. elegans UNC5 transmembrane protein, and the C-terminal 865-amino acid region of Rcm is 30% identical to UNC5. In addition, the UNC5 protein is essential for dorsal guidance of pioneer axons and for the movement of cells away from the netrin ligand. Ackerman et al. (1997). In the developing brain of vertebrates, netrin-1 plays a role in both cell migration and axonal guidance.

In the developing nervous system, migrating cells and axons are guided to their targets by cues in the extracellular environment. The netrins are a family of phylogenetically conserved guidance cues that can function as diffusible attractants and repellents for different classes of cells and axons. In vertebrates, insects and nematodes, members of the DCC subfamily of the immunoglobulin superfamily have been implicated as receptors that are involved in migration towards netrin sources. In Caenorhabditis elegans, the transmembrane protein UNC-5 has been implicated in these responses, as loss of UNC-5 function causes migration defects and ectopic expression of UNC-5 in some neurons can redirect their axons away from a netrin source.

The disclosed NOV1 nucleic acid of the invention encoding a UNC5H2-like protein includes the nucleic acid whose sequence is provided in Table 1A, 1C or a fragment thereof. The invention also includes a mutant or variant nucleic acid any of whose bases may be changed from the corresponding base shown in Table 1A or 1C while still encoding a protein that maintains its UNC5H2 like activities and physiological functions, or a fragment of such a nucleic acid. The invention further includes nucleic acids whose sequences are complementary to those just described, including nucleic acid fragments that are complementary to any of the nucleic acids just described. The invention additionally includes nucleic acids or nucleic acid fragments, or complements thereto, whose structures include chemical modifications. Such modifications include, by way of nonlimiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject. In the mutant or variant nucleic acids, and their complements, up to about 16 percent of the bases may be so changed.

The disclosed NOV1 protein of the invention includes the UNC5H2-like protein whose sequence is provided in Table 1B or 1D. The invention also includes a mutant or variant protein any of whose residues may be changed from the corresponding residue shown in Table 1B or 1D while still encoding a protein that maintains its UNC5H2-like activities and physiological functions, or a functional fragment thereof. In the mutant or variant protein, up to about 9 percent of the residues may be so changed.

The invention further encompasses antibodies and antibody fragments, such as $F_{ab}$ or $(F_{ab})_2$, that bind immunospecifically to any of the proteins of the invention.

The above defined information for this invention suggests that this UNC5H2-like protein (NOV1) may function as a member of a "UNC5H2 family". Therefore, the NOV1 nucleic acids and proteins identified here may be useful in potential therapeutic applications implicated in (but not limited to) various pathologies and disorders as indicated below. The potential therapeutic applications for this invention include, but are not limited to: protein therapeutic, small molecule drug target, antibody target (therapeutic, diagnostic, drug targeting/cytotoxic antibody), diagnostic and/or prognostic marker, gene therapy (gene delivery/gene ablation), research tools, tissue regeneration in vivo and in vitro of all tissues and cell types composing (but not limited to) those defined here.

The NOV1 nucleic acids and proteins of the invention are useful in potential therapeutic applications implicated in cancer including but not limited to various pathologies and disorders as indicated below. For example, a cDNA encoding the UNC5H2-like protein (NOV1) may be useful in gene therapy, and the UNC5H2-like protein (NOV1) may be useful when administered to a subject in need thereof. By way of nonlimiting example, the compositions of the present invention will have efficacy for treatment of patients suffering from cardiomyopathy, atherosclerosis, hypertension, congenital heart defects, aortic stenosis, atrial septal defect (ASD), atrioventricular (A-V) canal defect, ductus arteriosus, pulmonary stenosis, subaortic stenosis, ventricular septal defect (VSD), valve diseases, tuberous sclerosis, scleroderma, obesity, transplantation, diabetes, autoimmune disease, renal artery stenosis, interstitial nephritis, glomerulonephritis, polycystic kidney disease, systemic lupus erythematosus, renal tubular acidosis, IgA nephropathy, hypercalceimia, Lesch-Nyhan syndrome, Von Hippel-Lindau (VHL) syndrome, Alzheimer's disease, stroke, tuberous sclerosis, Parkinson's disease, Huntington's disease, cerebral palsy, epilepsy, Lesch-Nyhan syndrome, multiple sclerosis, ataxia-telangiectasia, leukodystrophies, behavioral disorders, addiction, anxiety, pain, neuroprotection, cancers, and/or other pathologies and disorders. For example, a cDNA encoding the transmembrane receptor UNC5H2-like protein may be useful in transmembrane receptor UNC5H2 therapy, and the transmembrane receptor UNC5H2-like protein may be useful when administered to a subject in need thereof. By way of nonlimiting example, the compositions of the present invention will have efficacy for treatment of patients suffering from cardiomyopathy, atherosclerosis, hypertension, congenital heart defects, aortic stenosis, atrial septal defect (ASD), atrioventricular (A-V) canal defect, ductus arteriosus, pulmonary stenosis, subaortic stenosis, ventricular septal defect (VSD), valve diseases, tuberous sclerosis, scleroderma, obesity, transplantation, diabetes, autoimmune disease, renal artery stenosis, interstitial nephritis, glomerulonephritis, polycystic kidney disease, systemic lupus erythematosus, renal tubular acidosis, IgA nephropathy, hypercalceimia, Lesch-Nyhan syndrome, Von Hippel-Lindau (VHL) syndrome, Alzheimer's disease, stroke, tuberous sclerosis, Parkinson's disease, Huntington's disease, cerebral palsy, epilepsy, Lesch-Nyhan syndrome, multiple sclerosis, ataxia-telangiectasia, leukodystrophies, behavioral disorders, addiction, anxiety, pain, neuroprotection, cancers, and other diseases, disorders and conditions of the like. Also since this gene is expressed at a measurably higher level in several cancer cell lines (including breast cancer, CNS cancer, colon cancer, gastric cancer, lung cancer, melanoma, ovarian cancer and pancreatic cancer), it may be useful in diagnosis and treatment of these cancers. The NOV1 nucleic acid encoding the UNC5H2-like protein of the invention, or fragments thereof, may further be useful in diagnostic applications, wherein the presence or amount of the nucleic acid or the protein are to be assessed.

NOV1 nucleic acids and polypeptides are further useful in the generation of antibodies that bind immuno-specifically to the novel NOV1 substances for use in therapeutic or diagnostic methods. These antibodies may be generated according to methods known in the art, using prediction from hydrophobicity charts, as described in the "Anti-NOVX Antibodies" section below. The disclosed NOV1 proteins have multiple hydrophilic regions, each of which can be used as an immunogen. In one embodiment, a contemplated NOV1 epitope is from about amino acids 1 to 100. In another embodiment, a NOV1 epitope is from about amino acids 200 to 300. In further embodiments, a NOV1 epitope is from about amino acids 450 to 500, from about amino acids 600 to 900, from about amino acids 950 to 1000, from about amino acids 1200 to 1300, from about amino acids 1400 to 1600, from about amino acids 1800 to 1900, from about amino acids 1950 to 2050, and from about amino acids 2200 to 2300. These novel proteins can be used in assay systems for functional analysis of various human disorders, which will help in understanding of pathology of the disease and development of new drug targets for various disorders.

NOV2

NOV2 includes three novel protein tyrosine phosphatase precursor-like proteins disclosed below. The disclosed sequences have been named NOV2a, NOV2b, and NOV2c.

NOV2a

A disclosed NOV2a nucleic acid of 6994 nucleotides (also referred to as SC126422078_A) encoding a receptor protein tyrosine phosphatase precursor-like protein is shown in Table 2A. An open reading frame was identified beginning with an ATG initiation codon at nucleotides 31–33 and ending with a TAA codon at nucleotides 6874–6876. A putative untranslated region upstream from the initiation codon and downstream from the termination codon is underlined in Table 2A. The start and stop codons are in bold letters.

TABLE 2A

NOV2a nucleotide sequence.

(SEQ ID NO:5)
<u>TGATTCTACTGGCTGAAAAATGTAATAAAG</u>ATGGATTTTCTTATCATTTTTCTTTTACTTTTTATTGGGACT

TCAGAGACACAGGTAGATGTTTCCAATGTCGTTCCTGGTACTAGGTACGATATAACCATCTCTTCAATTTCT

ACAACATACACCTCACCTGTTACTAGAATAGGGGCTTCTAATGAACCAGGGCCTCCAGTCTTCCTAGCCGGG

GAAAGAGTCGGATCTGCTGGGATTCTTCTGTCTTGGAATACACCACCTAATCCAAATGGAAGGATTATATCT

TACATTGTCAAATATAAGGAAGTTTGTCCGTGGATGCAAACAGTATATACACAAGTCAGATCAAAGCCAGAC

AGTCTGGAAGTTCTTCTTACTAATCTTAATCCTGGAACAACATATGAAATTAAGGTAGCTGCTGAAAACAGT

TABLE 2A-continued

NOV2a nucleotide sequence.

```
GCTGGCATTGGAGTGTTTAGTGATCCATTTCTCTTCCAAACTGCAGAAAGTGCTCCAGGAAAAGTGGTGGAT
TTCACAGGTGAGGCTGTCCCGTTCAGCAGTAAGCTGATGTGGTATACCTCGGCAACCAAAAAAAAAATTACC
AGCTTCAAGATTAGTGTCAAGCATAACAGAAGTGCGATAGTAGTGAAAGAAGTGTCAATCAGAGTGGAGTGC
ATTTTAAGTGCTTCCCTTCCTTTGCACTGCAACGAGAATAGTGAATCTTTTTTATCCAGTACACCCAGCCCT
TCTCCAACCCTTGGTAGAGTTACACCTCCATCGCGTACCACACATTCATCAAGCACGTTGACACAGAATGAG
ATCAGCTCTGTGAAAGAGCCTATCAGTTTTGTAGTGACACACTTGAGACCTTATACAACATATCTTTTTGAA
GTTTCAGCTGCTACAACTGAAGCAGGTTATATTGATAGTACGATTGTCAGAACACCAGAATCAGTGCCTGAA
GGACCACCACAAAACTGCGTAACAGGCAACATCACAGGAAAGTCCTTTTCAATTTTATGGGACCCACCAACT
ATAGTAACAGGGAAATTTAGTTATAGAGTTGAATTATATGGACCATCAGCAGGTCGCATTTTGGATAACAGC
ACAAAAGACCTCAAGTTTCATTCACTAACCTAACACCATTTACAATGTATGATGTCTATATTGCGGCTGAA
ACCAGTGCAGGGACTGGGCCCAAGTCAAATATTTCAGTATTCACTCCACCAGATGTTCCAGGGGCAGTGTTT
GATTTACAACTTGCAGAGGTAGAATCCACGCAAGTAACAATTACTTGGAAGAAACCACGACAACCAAATGGA
ATTATTAACCAATACCGAGTGAAAGTGCTAGTTCCAGAGACAGGAATAATTTTGGAAAATACTTTGCTCACT
GGAAATAATGAGATAAATGACCCCATGGCTCCAGAAATTGTGAACATAGTACAGCCAATGGTAGGATTATAT
GAGGGTTCAGCAGAGATGTCGTCTGACCTTCACTCACTTGCTACATTTATATATAACAGCCATCCACATAAA
AACTTTCCTGCAAGGAATAGAGCTGAAGACCAGACTTCACCAGTTGTAACTACAAGGAATCAGTATATTACT
GACATTGCAGCTGAACAGCTGACTTATGTTCTTATCAGATTAACGAGATTTTGGGCTGAGACAATGGGGTTT
TCTAGATATACAATCATGTCATCTGCAAGCAGGGACAATTTGACTTCCCCAGGCCCTTTGTCAGCCCAAAAT
TTCAGAGTTACACATGTTACCATAACAGAAGTATTTTTACACTGGGATCCTCCAGATCCTGTATTTTTTCAT
CATTACCTTATCACTATTTTGGATGTTGAAAACCAATCCAAGAGTATTATTTTAAGGACATTAAACAGTTTG
TCTCTTCTCCTTATAGGGTTAAAGAAATACACAAAATACAAAATGAGAGTGGCAGCCTCAACCCACCTTGGA
GAAAGTTCTTTGTCTGAAGAAAATGACATCTTTGTGAGAACTTCAGAAGATGAACCGGAATCATCACCTCAA
GATGTCGAAGTAATTGATGTTACCGCAGATGAAATAAGGTTGAAGTGGTCACCACCCGAAAAGCCCAATCGG
ATCATTATTGCTTATGAAGTGCTATATAAAAATATAGATACTTTATATATGAAGAACACATCAACAACAGAC
ATAATATTAAGGAACTTAAGACCTCACACCCTCTATAACATTTCTGTAAGGTCTTACACCAGATTTGGTCAT
GGCAATCAGGTATCTTCTTTACTCTCTGTAAGGACTTCGGAGTCAGTGCCTGATAGTGCACCAGAAAATATC
ACTTACAAAAATATTTCTTCTGGACAGATTGAGCTATCATTCCTTCCCCCAACTAGTCCCAATGGAATCATA
CAAAAATATACAATTTATCTCAAGAGAAGTAATGGAAATGAGGAAAGAACTATAAATACAACCTCTTTAACC
CAAAACATTAAAGGTCTGAAGAAATATACCCAATATHTCATTGAGGTGTCTGCTAGTACACTCAAAGGTGAA
GGAGTTCGGAGTGCTCCCATAAGTATACTGACGGAGGAAGATGCTCCTGATTCTCCCCCTCAAGACTTCTCT
GTAAAACAGTTGTCTGGTGTCACGGTGAAGTTGTCATGGCAACCACCCCTGGAGCCAAATGGAATTATCCTT
TATTACACAGTTTATGTCTGGAGATCATCATTAAAAACTATTAATGTCACTGAAACATCATTGGAGTTATCA
GATTTGGATTATAATGTTGAATACAGTGCTTATGTAACAGCTAGCACCAGATTTGGTGATGGGAAAACAAGA
AGCAATATCATTAGCTTTCAAACACCAGAGGGACCAAGCGATCCTCCCAAAGATGTTTATTATGCAAACCTC
AGTTCTTCATCAATAATTCTTTTCTGGACACCTCCTTCAAAACCTAATGGGATTATACAATATTACTCTGTT
TATTACAGAAATACTTCACGTACTTTTATGCAGAATTTTACACTCCATGAAGTAACCAATGACTTTGACAAT
ATGACTGTATCCACAATTATAGATAAACTGACAATATTCAGCTACTATACATTTTGGTTAACAGCAAGTACT
TCAGTTGGAAATGGGAATAAAACCAGTGACATCATTGAAGTATACACAGATCAAGACGTACCTGAAGGGTTT
GTTGGAAACCTGACTTACGAATCCATTTCGTCAACTGCAATAAATGTAAGCTCGTCCCACCGGCTCAACCA
```

TABLE 2A-continued

NOV2a nucleotide sequence.

```
AACGGTCTAGTCTTCTACTATGTTTCACTGATCTTACAGCAGACTCCTCGCCATGTGACACCACCTCTTGTT

ACATATGAGAGAAGCATATATTTTGATAATCTGGAAAAATACACTGATTATATATTAAAAATTACTCCATCA

ACAGAAAAGGGATTCTCTGATACCTATACTGCCCAGCTATACATCAAGACTGAAGAAGATATCCCAGAAACT

TCACCAATAATCAACACTTTTAAAAACCTTTCCTCTACCTCAGTTCTCTTATCATGGGATCCCCCAGTAAAG

CCAAATGGTGCAATAATAAGTTATGATTTAACTTTACAAGGACCAAATGAAAATTATTCTTTCATTACTTCT

GATAATTACATAATATTGGAAGAGCTTTCACCATTTACATTATATAGCTTTTTTGCTGCCGCAAGAACTAGA

AAAGGACTTGGTCCTTCCAGTATTCTTTTCTTTTACACAGATGAGTCAGTGCCGTTAGCACCTCCACAAAAT

TTGACTTTAATCAACTGTACTTCAGACTTTGTATGGCTGAAATGGAGCCCAAGTCCTCTTCCAGGTGGTATT

GTTAAAGTATATAGTTTTAAAATTCATGAACATGAAACTGACACTATATATTATAAGAATATATCAGGATTT

AAAACTGAAGCCAAACTTGTTGGACTGGAACCAGTCAGCACCTACTCTATCCGTGTATCTGCGTTCACCAAA

GTTGGAAATGGCAATCAATTTAGTAATGTAGTAAAATTCACAACCCAACAATCAGTTCCAGATGTCGTGCAG

AATATGCAGTGCATGGCAACTAGCTGGCAGTCAGTTTTAGTGAAATGGGATCCACCCAAAAAGGCAAATGGA

ATAATAACGCAGTATATGGTAACAGTTGAAAGGAATTCTACAAAAGTTTCTCCCCAAGATCACATGTACACT

TTCATAAAGCTTCTTGCCAATACCTCATATGTCTTTAAAGTAAGAGCTTCAACCTCAGCTGGTGAAGGTGAT

GAAAGCACATGCCATGTCAGCACACTACCTGAAACAGTTCCCAGTGTTCCCACAAATATTGCTTTTTCTGAT

GTTCAGTCAACTAGTGCAACATTGACATGGATAAGACCTGACACTATCCTTCGCTACTTTCAAAATTACAAA

ATTACCACTCAACTTCGTGCTCAAAAATGCAAAGAATGGGAATCCGAAGAATGTGTTGAATATCAAAAAATT

CAATACCTCTATGAAGCTCACTTAACTGAAGAGACAGTATATGGATTAAAGAAATTTAGATGGTATAGATTC

CAAGTGGCTGCCACCACCAATGCTGGCTATGGCAATGCTTCAAACTGGATTTCTACAAAAACTCTGCCTGGC

CCTCCAGATGGTCCTCCTGAAAATGTTCATGTAGTAGCAACATCACCTTTTAGCATCAGCATAAGCTGGAGT

GAACCTGCTGTCATTACTCGACCAACATGTTATCTGATTGATGTCAAATCGGTAGATAATGATGAATTTAAT

ATATCCTTCATCAAGTCAAATGAAGAAAATAAAACCATAGAAATTAAAGATTTAGAAATATTCACAAGGTAT

TCTGTAGTGATCACTGCATTTACTGGGAACATTAGTGCTGCATATGTAGAAGGGAAGTCAAGTGCTGAAATG

ATTGTTACTACTTTAGAATCAGCCCCAAAGGACCCACCTAACAACATGACATTTCAGAAGATACCAGATGAA

GTTACAAAATTTCAATTAACGTTCCTTCCTCCTTCTCAACCTAATGGAAATATCCAAGTATATCAAGCTCTG

GTTTACCGAGAAGATGATCCTACTGCTGTCCAGATTCACAACCTCAGTATTATACAGAAAACCAACACATTC

GTCATTGCAATGCTAGAAGGACTAAAAGGTGGACATACATACAATATCAGTGTTTACGCAGTCAATAGTGCT

GGTGCAGGTCCAAAGGTTCCGATGAGAATAACCATGCATATCAAAGCTCCAGCACGACCAAAAACCAAACCA

ACCCCTATTTATGATGCCACAGGAAAACTGCTTGTGACTTCAACAACAATTACAATCAGAATGCCAATATGT

TACTACAGTGATGATCATCGACCAATAAAAAATGTACAAGTGCTTGTGACAGAAACAGGAGCTCAGCATGAT

GGAAATGTAACAAAGTGGTATGATGCATATTTTAATAAAGCAAGGCCATATTTTACAAATGAAGGCTTTCCT

AACCCTCCATGTACACAAGGAAAGACAAAGTTTAGTGGCAATGAAGAAATCTACATCATAGGTGCTCATAAT

GCATGCATGATTCCTGGCAATGAAGACAAAATTTGCAATGGACCACTGAAACCAAAAAAGCAATACTTATTT

AAATTTAGAGCTACAAATATTATGGGACAATTTACTGACTCTGATTATTCTGACCCTGTTAAGACTTTAGGC

GAAGGACTTTCAGAAAGAACCGTAGAGATCATTCTTTCCGTCACTTTGTGTATCCTTTCAATAATTCTCCTT

GGAACAGCTATTTTTGCATTTGCAAGAATTCGACAGAAGCAGAAAGAAGGTGGCACATACTCTCCTCAGGAT

GCAGAAATTATTGACACTAAATTGAAGCTGGATCACCTCATCACAGTGGCAGACCTGGAACTGAAGGACGAG

AGATTAACGCGGCCAATAAGCAAGAAATCCTTCCTGCAACATGTTGAAGAGCTTTCCACAAACAACAACCTA
```

TABLE 2A-continued

NOV2a nucleotide sequence.

AAGTTTCAAGAAGAATTTTCGGAATTACCAAAATTTCTTCAGGATCTTTCTTCAACTGATGCTGATCTGCCT

TGGAATAGAGCAAAAAACCGCTTCCCAAACATAAAACCATATAATAATAACAGAGTAAAGCTGATAGCTGAC

GCTAGTGTTCCAGGTTCGGATTATATTAATGCCAGCTATATTTCTGGTTATTTATGTCCAAATGAATTTATT

GCTACTCAAGGTCCACTACCAGGAACAGTTGGAGATTTTTGGAGAATGGTGTGCGAAACCAGAGCAAAAACA

TTAGTAATGCTAACACAGTGTTTTGAAAAAGOACGGATCAGATGCCATCAGTATTGGCCAGAGGACAACAAG

CCAGTTACTGTCTTTGGAGATATAGTGATTACAAAGCTAATGGAGGATGTTCAAATAGATTGGACTATCAGG

GATCTGAAAATTGAAAGGCATGGGGATTGCATGACTGTTCGACAGTGTAACTTTACTGCCTGGCCAGAGCAT

GGGGTTCCTGAGAACAGCCCCCCTCTAATTCACTTTGTGAAGTTGGTTCGAGCAAGCAGGGCACATGACACC

ACACCTATGATTGTTCACTCCAGTGCTGGACTTGGAAGAACTGGAGTTTTTATTGCTCTGGACCATTTAACA

CAACATATAAATCACCATGATTTTGTGGATATATATGGACTAGTAGCTGAACTGACAAGTGAAAGAATGTGC

ATGGTGCAGAATCTGGCACAGTATATCTTTTTACACCAGTGCATTCTGGATCTCTTATCAAATAAGGGAAGT

AATCAGCCCATCTGTTTTCTTAACTATTCAGCACTTCAGAAGATGGACTCTTTGGACGCCATGGAAGGTGGT

GATGTTGAGCTTGAATGGGAAGAAACCACTATGTAAATATTCAGACCAAAGGATACAATTGGAAGAGATTTT

TAAATCCCAGGGGCCAAAGTTACCCCCTCATTCTTCCGAATTGAAATGTGCAACCTTAAACAAATATCTATG

CTTCTCTCAC

In a search of public sequence databases, the NOV2a nucleic acid sequence, located on chromsome 12 has 777 of 3293 bases (84%) identical to a gb:GENBANK-ID:AF063249|acc:AF063249.1 mRNA from *Rattus norvegicus* (*Rattus norvegicus* glomerular mesangial cell receptor protein-tyrosine phosphatase precursor (PTPRQ) mRNA, complete cds) (E=0.0). Public nucleotide databases include all GenBank databases and the GeneSeq patent database.

The disclosed NOV2a polypeptide (SEQ ID NO:6) encoded by SEQ ID NO:5 has 2281 amino acid residues and is presented in Table 2B using the one-letter amino acid code. Signal P, Psort and/or Hydropathy results predict that NOV2a has a signal peptide and is likely to be localized in the plasma membrane with a certainty of 0.4600. In other embodiments, NOV2a may also be localized to the microbody (peroxisome) with acertainty of 0.1381, the endoplasmic reticulum (membrane) with a certainty of 0.1000 or in the endoplasmic reticulum (lumen) with a certainty of 0.1000. The most likely cleavage site for a NOV2a peptide is between amino acids 17 and 18, at: SET-QV.

TABLE 2B

Encoded NOV2a protein sequence.

(SEQ ID NO:6)
MDFLIIFLLLFIGTSETQVDVSNVVPGTRYDITISSISTTYTSPVTRIGASNEPGPPVFLAGERVGSAGILL

SWNTPPNPNGRIISYIVKYKEVCPWMQTVYTQVRSKPDSLEVLLTNLNPGTTYEIKVAAENSAGIGVFSDPF

LFQTAESAPGKVVDFTGEAVPFSSKLMWYTSATKKKITSFKISVKHNRSGIVVKEVSIRVECILSASLPLHC

NENSESFLWSTASPSPTLGRVTPPSRTTHSSSTLTQNEISSVKEPISFVVTHLRPYTTYLFEVSAATTEAGY

IDSTIVRTPESVPEGPPQNCVTGWITGKSFSILWDPPTIVTGKFSYRVELYGPSAGRILDNSTKDLKFAFTN

LTPFTMYDVYIAAETSAGTGPKSNISVFTPPDVPGAVFDLQLAEVESTQVRITWKKPRQPNGIINQYRVKVL

VPETGIILENTLLTGNNEINDPMAPEIVNIVQPMVGLYEGSAEMSSDLHSLATFIYNSHPDKNFPARNRAED

QTSPVVTTRNOYITDIAAEQLTYVLIRLRRFWAETMGPSRYTIMSSASRDNLTSPGPLSAQNFRVTHVTITE

VFLHWDPPDPVFFHHYLITILDVENQSKSIILRTLNSLSLVLIGLKKYTKYKMRVAASTHVGESSLSEENDI

FVRTSEDEPESSPQDVEVIDVTADEIRLKWSPPEKPNGIIAYEVLYKNIDTLYMKNTSTTDIILRNLRPHT

LYNISVRSYTRFGHGNQVSSLLSVRTSESVPDSAPENITYKNISSGEIELSFLPPSSPNGIIQKYTIYLKRS

NGNEERTINTTSLTQNIKGLKKYTOYIIEVSASTLKGEGVRSAPISILTEEDAPDSPPQDFSVKOLSGVTVK

LSWQPPLEPNGIILYYTVYVWRSSLKTINVTETSLELSDLDYNVEYSAYVTASTRFGDGKTRSNIISFQTPE

TABLE 2B-continued

Encoded NOV2a protein sequence.

GPSDPPKDVYYANLSSSSIILFWTPPSKPNGIIQYYSVYYRNTSGTFMQNFTLHEVTNDFDNMTVSTIIDKL

TIFSYYTFWLTASTSVGNGNKSSDIIEVYTDQDVPEGFVGNLTYESISSTAINVSWVPPAQPNGLVFYYVSL

ILQQTPRHVRPPLVTYERSIYFDNLEKYTDYILKITPSTEKGFSDTYTAQLYIKTEEDIPETSPIINTFKNL

SSTSVLLSWDPPVKPNGAIISYDLTLQGPNENYSFITSDNYIILEELSPFTLYSFFAAARTRKGLCPSSILF

FYTDESVPLAPPQNLTLINCTSDFVWLKWSPSPLPGGIVKVYSFKIHEHETDTIYYKNISGFKTEAKLVGLE

PVSTYSIRVSAFTKVGNGNQFSNVVKFTTQESVPDVVQNMQCMATSWQSVLVKWDPPKKANGIITQYMVTVE

RNSTKVSPQDHMYTFIKLLANTSYVFKVRASTSAGEGDESTCHVSTLPETVPSVPTNIAFSDVOSTSATLTW

IRPDTILGYFQNYKITTQLRAQKCKEWESEECVEYQKIQYLYEAHLTEETVYGLKKFRWYRFQVAASTNAGY

GNASNWISTKTLPGPPDGPPENVHVVATSPFSISISWSEPAVITCPTCYLIDVKSVDNDEFNISFIKSNEEN

KTIEIKDLEIFTRYSVVITAFTGNISAAYVEGKSSAEMIVTTLESAPKDPPNNMTFQKIPDEVTKFQLTFLP

PSQPNGNIQVYQALVYREDDPTAVQIHNLSIIQKTNTFVIAMLEGLKGGHTYNISVYAVNSAGAGPKVPMRI

TMDIKAPARPKTKPTPIYDATGKILVTSTTITIRMPICYYSDDHGPIKNVQVLVTETGAQHDGNVTKWYDAY

FNKARPYFTNEGFPNPPCTEGKTKFSGNEEIYIIGADNACMIPGNEDKICNCPLKPKKQYLFKFRATNIMGQ

FTDSDYSDPVKTLGEGLSERTVEIILSVTLCILSIILLGTAIFAFARIRQKQREGGTYSPQDAEIIDTKLKL

DQLITVADLELKDERLTRPISKKSFLQHVEELCTNNNLKFQEEFSELPKFLQDLSSTDADLPWNRAKNRFPN

IKPYNNNRVKLIADASVPGSDYINASYISGYLCPNEFIATQGPLPGTVGDFWRMVWETRAKTLVMLTQCFEK

GRIRCHQYWPEDNKPVTVFGDIVITKLMEDVQIDWTIRDLKIERHGDCMTVRQCNFTAWPEHGVPENSAPLI

HFVKLVRASRAHDTTPMIVHCSAGVGRTGVFIALDHLTQHINDHDFVDIYGLVAELRSERMCMVQNLAQYIF

LHQCILDLLSNKGSNQPICFVNYSALQKMDSLDAMEGGDVELEWEETTM

A search of sequence databases reveals that the NOV2a amino acid sequence has 1894 of 2301 amino acid residues (82%) identical to, and 2078 of 2301 amino acid residues (90%) similar to, the 2302 amino acid residue ptnr:SPTREMBL-ACC:O88488 protein from *Rattus norvegicus* (Rat) (Glomerular Mesangial Cell Receptor Protein-Tyrosine Phosphatase Precursor (EC 3.1.3.48)) (E=0.0). Public amino acid databases include the GenBank databases, SwissProt, PDB and PIR.

NOV2 is expressed in at least kidney and colon. This information was derived by determining the tissue sources of the sequences that were included in the invention including but not limited to SeqCalling sources, Public EST sources, Literature sources, and/or RACE sources.

In addition, the sequence is predicted to be expressed in *Rattus norvegicus*:kidney because of the expression pattern of (GENBANK-ID: gb:GENBANK-ID:AF063249|acc:AF063249.1) a closely related *Rattus norvegicus* glomerular mesangial cell receptor protein-tyrosine phosphatase precursor (PTPRQ) mRNA, complete cds homolog.

NOV2b

A disclosed NOV2b nucleic acid of 2565 nucleotides (also referred to as CG50718-02) encoding a novel Glomerular Mesangial Cell Receptor Protein-Tyrosine-like protein is shown in Table 2C. An open reading frame was identified beginning with an AGA codon at nucleotides 1–3 and ending with a GAG codon at nucleotides 2563–2565. The start and stop codons are in bold letters in Table 2C. Because the first and last codons are not traditional initiation and termination codons, NOV2b could represent a partial reading frame that extends in the 5' and/or 3' directions.

TABLE 2C

NOV2b nucleotide sequence.

(SEQ ID NO:7)

AGATCTCCTGAAGGGTTTGTTGGAAACCTGACTTACGAATCCATTTCGTCAACTGCAATAAATGTAAGCTGG

GTCCCACCGGCTCAACCAAACGGTCTAGTCTTCTACTATGTTTCACTGATCTTACAGCAGACTCCTCGCCAT

GTGAGACCACCTCTTGTTACATATGAGAGAAGCATATATTTTGATAATCTGGAAAAATACACTGATTATATA

TTAAAAATTACTCCATCAACAGAAAAGGGATTCTCTGATACCTATACTGCCCAGCTATACATCAAGACTGAA

TABLE 2C-continued

NOV2b nucleotide sequence.

GAAGATGTCCCAGAAACTTCACCAATAATCAACACTTTTAAAAACCTTTCCTCTACCTCAGTTCTCTTATCA
TGGGATCCCCCAGTAAAGCCAAATGGTGCAATAATAAGTTATGATTTAACTTTACAAGGACCAAATGAAAAT
TATTCTTTCATTACTTCTGATAATTACATAATATTGGAAGAGCTTTCACCATTTACATTATATACCTTTTTT
GCTGCCGCAAGAACTAGAAAAGGACTTGGTCCTTCCAGTATTCTTTTCTTTTACACAGATGAGTCAGTGCCG
TTAGCACCTCCACAAAATTTGACTTTAATCAACTGTACTTCACACTTTGTATGGCTGAAATCGACCCCAAGT
CCTCTTCCAGGTGGTATTGTTAAAGTRATATAGTTTTAAATTCATGAACATGAAACTGACACTATATATTAT
AAGAATATATCAGGATTTAAAACTGAAGCCAAACTTGTTGGACTGGAACCAGTCACCACCTACTCTATCCGT
GTATCTGCGTTCACCAAAGTTGGAAATGGCAATCAATTTAGTAATGTAGTAAAATTCACAACCCAAGAATCA
GTTCCAGATGTCGTGCAGAATATGCAGTGCATGGCAACTAGCTGGCAGTCAGTTTTAGTGAAATGGGATCCA
CCCAAAAAGGCAAATGGAATAATAACGCAGTATATGGTAACAGTTGAAAGGAATTCTACAAAAGTTTCTCCC
CAAGATCACATGTACACTTTCATAAAGCTTCTTGCCAATACCTCATATGTCTTTAAAGTAAGAGCTTCAACC
TCAGCTGGTGAAGGTGATGAAAGCACATGCCATGTCAGCACACTACCTGAAACAGTTCCCAGTGTTCCCACA
AATATTGCTTTTTCTGATGTTCAGTCAACTAGTGCAACATTGACATGGATAAGACCTGACACTATCCTTGGC
TACTTTCAAAATTACAAAATTACCACTCAACTTCGTGCTCAAAAATGCAAAGAATGGGAATCCGAAGAATGT
GTTGAATATCAAAAAATTCAATACCTCTATGAAGCTCACTTAACTGAAGAGACAGTATATGGATTAAAGAAA
TTTAGATGGTATAGATTCCAAGTGGCTGCCAGCACCAATGCTGGCTATGGCAATGCTTCAAACTGGATTTCT
ACAAAAACTCTGCCTGGCCCTCCAGATGGTCCTCCTGAAAATGTTCAATGTAGTAGCAACATCACCTTTTAC
ATCAGCATAAGCTGGAGTGAACCTGCTGTCATTACTGGACCAACATGTTATCTGATTGATGTCAAATCGGTA
GATAATGATGAATTTAATATATCCTTCATCAAGTCAAATGAAGAAAATAAAACCATAGAAATTAAAGATTTA
GAAATATTCACAAGGTATTCTGTAGTGATCACTGCATTTACTGGGAACATTAGTGCTGCATATGTAGAAGGG
AAGTCAAGTGCTGAAATGATTGTTACTACTTTAGAATCAGCCCCAAAGGACCCACCTAACAACATGACATTT
CAGAAGATACCAGATGAAGTTACAAAATTTCAATTAACGTCCCTTCCTCCTTCTCAACCTAATGGAAATATC
CAAGTATATCAAGCTCTGGTTTACCGAGAAGATGATCCTACTGCTGTCCAGATTCACAACCTCAGTATTATA
CAGAAAACCAACACATTCGTCATTGCAATGCTAGAAGGACTAAAAGGTGGACATACATACAATATCAGTGTT
TACGCAGTCAATAGTGCTGGTGCAGGTCCAAAGGTTCCGATGAGAATAACCATGGATATCAAAGCTCCAGCA
CGACCAAAAACCAAACCAACCCCTATTTATGATGCCACAGGAAAACTGCTTGTGACTTCAACAACAATTACA
ATCAGAATGCCAATATGTTACTACAGTGATGATCATGGACCAATAAAAAATGTACAAGTGCTTGTGACAGAA
ACAGGAGCTCAGCATGATGGAAATGTAACAAAGTGGTATGATGCATATTTTAATAAAGCAAGGCCATATTTT
ACAAATGAAGGCTTTCCTAACCCTCCATGTACAGAAGGAAAGACAAAGTTTAGTGGCAATGAAGAAATCTAC
ATCATAGGTGCTGATAATGCATGCATGATTCCTGGCAATGAAGACAAAATTTGCAATGGACCACTGAAACCA
AAAAAGCAATACTTATTTAAATTTAGAGCTACAAATATTATGGGACAATTTACTGACTCTGATTATTCTGAC
CCTGTTAAGACTTTAGGCGAAGGACTTTCAGAAAAGAACCCTCGAG

The disclosed NOV2b polypeptide (SEQ ID NO:8) encoded by SEQ ID NO:7 has 855 amino acid residues and is presented in Table 2D using the one-letter amino acid code.

TABLE 2D

Encoded NOV2b protein sequence.

(SEQ ID NO:8)
RSPEGFVGNLTYESISSTAINVSWVPPAQPNGLVFYYVSLILQQTPRMVRPPLVTYERSIYFDNLEKYTDYI

LKITPSTEKGFSDTYTAQLYIKTEEDVPETSPIINTFKNLSSTSVLLSWDPPVKPNGAIISYDLTLQGPNEN

YSFITSDNYIILEELSPFTLYSFFAAARTRKGLGPSSTLFFYTDESVPLAPPQNLTLINCTSDFVWLKWSPS

PLPGGIVKVYSFKIHEHETDTIYYKNISGFKTEAKLVGLEPVSTYSIRVSAFTKVGNGNQFSNVVKFTTQES

VPDVVQNMQCMATSWQSVLVKWDPPKKANGIITQYMVTVERNSTKVSPQDHMYTFIKLLANTSYVFKVRAST

SAGEGDESTCHVSTLPETVPSVPTNIAFSDVQSTSATLTWIRPDTILGYFQNYKITTQLRAQKCKEWESEEC

VEYQKIQYLYEAHLTEETVYGLKKFRWYRFQVAASTNAGYGNASNWISTKTLPGPPDGPPENVHVVATSPFS

ISISWSEPAVITGPTCYLIDVKSVDNDEFNISFIKSNEENKTIEIKDLEIPTRYSVVITAFTGNISAAYVEG

KSSAEMIVTTLESAPKDPPNNMTFQKIPDEVTKFQLTSLPPSQPNGNIQVYQALVYREDDPTAVQIHNLSII

QKTNTFVIAMLEGLKGGHTYNISVYAVNSAGAGPKVPMRITMDIKAPARPKTKPTPIYDATGKLLVTSTTIT

IRMPICYYSDDHGPIKNVQVLVTETGAQHDGNVTKWYDAYFNKARPYFTNEGFPNPPCTEGKTKFSGNEEIY

IIGADNACMIPGNEDKICNGPLKPKKQYLFKFRATNIMGQFTDSDYSDPVKTLGEGLSERTLE

NOV2b is expressed in Brain, Colon, Fetal brain, Germ Cell, Heart, Kidney, Prostate, Uterus, brain, breast, colon, kidney, lung.

NOV2c

A disclosed NOV2c nucleic acid of 6903 nucleotides (also referred to as CG50718-05) encoding a novel Glomerular Mesangial Cell Receptor Protein-Tyrosine Phosphatase Precursor-like protein is shown in Table 2E. An open reading frame was identified beginning with an ATG initiation codon at nucleotides 1–3 and ending with a TGA codon at nucleotides 6901–6903. A putative untranslated regions upstream from the initiation codon and downstream of the termination codon are underlined in Table 2E. The start and stop codons are in bold letters.

TABLE 2E

NOV2c nucleotide sequence.

(SEQ ID NO:9)
ATGGATTTTCTTATCATTTTTCTTTTACTTTTTATTGGGACTTCAGAGACACAGGTAGATGTTTCCAATGTC

GTTCCTGGTACTAGGTACGATATAACCATCTCTTCAATTTCTACAACATACACCTCAcCTGTTACTAGAATA

GTGACAACAAATGTAACAGAACCAGGGCCTCCAGTCTTCCTAGCCGGGGAAAGAGTCGGATCTGCTGGGATT

CTTCTGTCTTGGAATACACCACCTAATCCAAATGGAAGGATTATATCTTACATTGTCAAATATAAGCAAGTT

TGTCCGTGGATGCAAACAGTATATACACAAGTCAGATCAAAGCCAGACAGTCTGCAAGTTCTTCTTACTAAT

CTTAATCCTGGAACAACATATGAAATTAAGGTAGCTGCTGAAAACAGTGCTGGCATTGGAGTGTTTAGTGAT

CCATTTCTCTTCCAAACTGCAGAAAGTCCACCTCCAGGAAAAGTGGTGAATCTCACAGTTGAGGCCTACAAC

GCTTCAGCAGTTAAGCTGATTTGGTATTTACCTCGGCAACCAAATGGCAAAATTACCAGCTTCAAGATTAGT

GTCAAGCATGCCAGAAGTGGGATAGTAGTGAAACATGTCTCAATCAGAGTAGAGGACATTTTGACTGGGAAA

TTGCCAGAATGCAATGTAGAGAATAGTGAATCTTTTTTATGGAGTACAGCCAGCCCTTCTCCAACCCTTGGT

TABLE 2E-continued

NOV2c nucleotide sequence.

```
AGAGTTACACCTCCATCGCGTACCACACATTCATCAAGCACGTTGACACAGAATGAGATCAGCTCTGTGTGG
AAAGAGCCTATCACTTTTGTAGTGACACACTTGAGACCTTATACAACATATCTTTTTGAAGTTTCAGCTGCT
ACAACTGAAGCAGGTTATATTGATAGTACGATTGTCAGAACACCAGAATCAGTGCCTGAAGGACCACCACAA
AACTGCGTAACAGOCAACATCACAGGAAAGTCCTTTTCAATTTTATGGGACCCACCAACTATAGTAACAGGG
AAATTTAGTTATAGAGTTGAATTATATGGACCATCAGGTCGCATTTTGGATAACACCACAAAACACCTCAAG
TTTGCATTCACTAACCTAACACCATTTACAATGTATGATGTCTATATTGCGGCTGAAACCAGTGCAGGGACT
GGGCOCAAGTCAAATATTTCAGTATTCACTCCACCAGATGTTCCAGGGGCAGTGTTTGATTTACAACTTCCA
GAGGTAGAATCCACGCAAGTAAGAATTACTTGGAAGAAACCACOACAACCAAATGGAATTATTAACCAATAC
CGAGTGAAAGTGCTAGTTCCAGAGACAGGAATAATTTTGGAAAATACTTTGCTCACTGGAAATAATGAGATA
AATGACCCCATGCCTCCAGAAATTGTGAACATAGTAGACCCAATGGTAGGATTATATGAGGGTTCAGCAGAG
ATGTCGTCTGACCTTCACTCACTTGCTACATTTATATATAACAGCCATCCAGATAAAAACTTTCCTGCAAGG
AATAGAGCTGAAGACCAGACTTCACCAGTTGTAACTACAAGGAATCAGTATATTACTGACATTGCAGCTGAA
CAGCTCTCTTATGTTATCAGGAGACTTGTACCTTTCACTGAGCACATGATTAGTGTATCTGCTTTCACCATC
ATGGGAGAAGGACCACCAACAGTTCTCAGTGTTAGGACACGTCAGCAAGTGCCAAGCTCCATTAAAATTATA
AACTATAAAAATATTAGTTCTTCATCTATTTTGTTATATTGGGATCCTCCAGAATATCCCAATGGAAAAATA
ACTCACTATACGATTTATGCAATGGAATTGGATACAAACAGAGCATTCCAGATAACTACCATAGATAACAGC
TTTCTCATAACAGGTATAGGGTTAAAGAAATACACAAAATACAAAATGAGAGTGGCAGCCTCAACCCACGTT
GGAGAAAGTTCTTTGTCTGAAGAAAATGACATCTTTGTGAGAACTTCAGAAGATGAACCGGAATCATCACCT
CAAGATGTCGAAGTAATTGATGTTACCGCAGATGAAATAAGGTTGAAGTGGTCACCACCCGAAAAGCCCAAT
GGGATCATTATTCCTTATGAAGTGCTATATAAAAATATAGATACTTTATATATGAAGAACACATCAACAACA
GACATAATATTAAGGAACTTAAGACCTCACACCCTCTATAACATTTCTGTAAGGTCTTACACCAGATTTGGT
CATGGCAATCAGGTATCTTCTTTACTCTCTGTAAGGACTTCGGAGACTGTGCCTGATAGTGCACCAGAAAAT
ATCACTTACAAAAATATTTCTTCTGGAGAGATTGAGCTATCATTCCTTCCCCCAAGTAGTCCCAATGGAATC
ATACAAAAATATACAATTTATCTCAAGAGAAGTAATGGAAATGAGGAAAGAACTATAAATACAACCTCTTTA
ACCCAAAACATTCTGAAGAAATATACCCAATATATCATTGACGTGTCTGCTAGTACACTCAAAGGTGAAGGA
GTTCGGAGTGCTCCCATAACTATACTGACGGAGGAAGATGCTCCTGATTCTCCCCCTCAAGACTTCTCTGTA
AAACAGTTGTCTGGTGTCACGGTGAAGTTGTCATGGCAACCACCCCTCGACCCAAATGGAATTATCCTTTAT
TACACAGTTTATGTCTGGAGGAATAGATCATCATTAAAAACTATTAATCTCACTGAAACATCATTGGAGTTA
TCAGATTTGGATTATAATGTTGAATACAGTGCTTATGTAACAGCTAGCACCAGATTTGGTGATGGGAAAACA
AGAAGCAATATCATTAGCTTTCAAACACCAGAGGGACCAAGCGATCCTCCCAAAGATGTTTATTATGCAAAC
CTCAGTTCTTCATCAATAATTCTTTTCTCGACACCTCCTTCAAAACCTAATGGGATTATACAATATTACTCT
GTTTATTACAGAAATACTTCAGGTACTTTTATGCAGAATTTTACACTCCATGAAGTAACCAATGACTTTGAC
AATATGACTGTATCCACAATTATAGATAAACTGACAATATTCAGCTACTATACATTTTGGTTAACAGCAAGT
ACTTCAGTTGGAAATGGGAATAAAAGCAGTGACATCATTGAAGTATACACAGATCAACACGTCCCTGAAGGG
TTTGTTGGAAACCTGACTTACGAATCCATTTCGTCAACTGCAATAAATCTAAGCTGGGTCCCACCGGCTCAA
CCAAACOGTCTAGTCTTCTACTATGTTTCACTCATCTTACACCAGACTCCTCGCCATGTGAGACCACCTCTT
GTTACATATGACACAAGCATATATTTTGATAATCTGGAAAAATACACTOATTATATATTAAAAATTACTCCA
TCAACACAAAAGGGATTCTCTGATACCTATACTGCCCAGCTATACATCAAGACTGAAGAAGATGTCCCAGAA
```

TABLE 2E-continued

NOV2c nucleotide sequence.

ACTTCACCAATAATCAACACTTTTAAAAACCTTTCCTCTACCTCAGTTCTCTTATCATGGGATCCCCAGTA
AAGCCAAATGGTGCAATAATAAGTTATGATTTAACTTTACAAGGACCAAATGAAAATTATTCTTTCATTACT
TCTGATAATTACATAATATTGGAAGAGCTTTCACCATTTACATTATATAGCTTTTTTGCTGCCGCAAGAACT
AGAAAAGGACTTCGTCCTTCCAGTATTCTTTTCTTTTACACAGATGAGTCAGTGCCGTTAGCACCTCCACAA
AATTTGACTTTAATCAACTGTACTTCAGACTTTGTATGGCTGAAATGGAGCCCAAGTCCTCTTCCAGGTGGT
ATTGTTAAAGTATATAGTTTTAAAATTCATGAACATCAAACTGACACTATATATTATAAGAATATATCAGGA
TTTAAAACTGAAGCCAAACTTGTTGGACTGGAACCAGTCAGCACCTACTCTATCCGTGTATCTGCGTTCACC
AAAGTTGGAAATGGCAATCAATTTAGTAATGTAGTAAAATTCACAACCCAAGAATCAGTTCCAGATGTCGTG
CAGAATATGCAGTGCATGGCAACTAGCTGGCAGTCAGTTTTAGTGAAATGGGATCCACCCAAAAACGCAAAT
GGAATAATAACGCAGTATATGGTAACAGTTGAAAGGAATTCTACAAAAGTTTCTCCCCAAGATCACATGTAC
ACTTTCATAAAGCTTCTTGCCAATACCTCATATGTCTTTAAAGTAAGAGCTTCAACCTCAGCTGGTGAAGGT
GATGAAAGCACATGCCATGTCAGCACACTACCTGAAACAGTTCCCAGTGTTCCCACAAATATTGCTTTTTCT
GATGTTCAGTCAACTAGTGCAACATTGACATGGATAAGACCTGACACTATCCTTCGCTACTTTCAAAATTAC
AAAATTACCACTCAACTTCGTGCTCAAAAATGCAAAGAATGGGAATCCGAAGAATGTGTTGAATATCAAAAA
ATTCAATACCTCTATGAAGCTCACTTAACTGAAGAGACAGTATATGGATTAAAGAAATTTAGATGCTATAGA
TTCCAAGTGCCTGCCAGCACCAATGCTGGCTATGGCAATGCTTCAAACTGGATTTCTACAAAAACTCTGCCT
GGCCCTCCAGATGGTCCTCCTGAAAATGTTCATGTAGTACCAACATCACCTTTTAGCATCAGCATAAGCTGG
AGTGAACCTGCTGTCATTACTGGACCAACATGTTATCTGATTGATGTCAAATCGGTAGATAATGATGAATTT
AATATATCCTTCATCAAGTCAAATGAAGAAAATAAAACCATAGAAATTAAAGATTTAGAAATATTCACAAGG
TATTCTGTAGTGATCACTGCATTTACTGGGAACATTAGTGCTGCATATGTAGAAGGGAAGTCAAGTGCTGAA
ATGATTGTTACTACTTTAGAATCAGCCCCAAAGGACCCACCTAACAACATGACATTTCAGAAGATACCACAT
GAACTTACAAAATTTCAATTAACGTCCCTTCCTCCTTCTCAACCTAATGGAAATATCCAAGTATATCAAGCT
CTGGTTTACCGAGAACATGATCCTACTGCTGTCCAGATTCACAACCTCAGTATTATACAGAAAACCAACACA
TTCGTCATTGCAATGCTAGAAGGACTAAAAGGTCGACATACATACAATATCAGTGTTTACGCAGTCAATAGT
GCTGGTCCACGTCCAAAGGTTCCGATGAGAATAACCATCGATATCAAAGCTCCAGCACGACCAAAAACCAAA
CCAACCCCTATTTATGATGCCACAGGAAAACTGCTTGTGACTTCAACAACAATTACAATCAGAATCCCAATA
TGTTACTACAGTGATGATCATGGACCAATAAAAAAATGTACAAGTGCTTGTGACAGAAACAGGAGCTCAGCAT
GATGGAAATGTAACAAAGTGGTATGATGCATATTTTAATAAAGCAAGGCCATATTTTACAAATGAAGGCTTT
CCTAACCCTCCATGTACAGAAGGAAAGACAAAGTTTAGTGGCAATGAAGAAATCTACATCATAGGTGCTGAT
AATGCATGCATGATTCCTGGCAATGAAGACAAAATTTGCAATGGACCACTGAAACCAAAAAAGCAATACTTA
TTTAAATTTAGAGCTACAAATATTATGGGACAATTTACTGACTCTGATTATTCTGACCCTGTTAAGACTTTA
GGCGAAGGACTTTCAGAAAGAACCCTAGAGATCATTCTTTCCGTCACTTTCTGTATCCTTTCAATAATTCTC
CTTGGAACAGCTATTTTTGCATTTGCAAGAATTCGACAGAAGCAGAAAGAAGGTGGCACATACTCTCCTCAG
GATGCAGAAATTATTGACACTAAATTCAAGCTGGATCAGCTCATCACAGTGGCAGACCTGGAACTGAAGGAC
GAGAGATTAACGCGGTTACTTAGTTATAGAAAATCCATCAAGCCAATAAGCAAGAAATCCTTCCTGCAACAT
GTTGAAGAGCTTTGCACAAACAACAACCTAAAGTTTCAAGAAGAATTTTCGGAATTACCAAAATTTCTTCAG
GATCTTTCTTCAACTGATGCTGATCTGCCTTGGAATAGAGCAAAAAACCGCTTCCCAAACATAAAACCATAT
AATAATAACAGAGTAAAGCTCATAGCTGACGCTAGTGTTCCAGGTTCGGATTATATTAATGCCAGCTATATT
TCTGGTTATTTATGTCCAAATGAATTTATTGCTACTCAAGGTCCACTACCAGGAACAGTTGGAGATTTTTGG

TABLE 2E-continued

NOV2c nucleotide sequence.

AGAATGGTGTGGGAAACCAGAGCAAAAACATTAGTAATGCTAACACAGTGTTTTGAAAAAGGACGGATCAGA

TGCCATCAGTATTGGCCAGAGGACAACAAGCCAGTTACTGTCTTTGGAGATATAGTGATTACAAAGCTAATG

GAGGATGTTCAAATAGATTGGACTATCAGGGATCTGAAAATTGAAACGCATGGGGATTGCATGACTGTTCGA

CAGTGTAACTTTACTGCCTGGCCAGAGCATGGGGTTCCTGAGAACAGCGCCCCTCTAATTCACTTTGTGAAG

TTGGTTCGAGCAAGCAGGGCACATCACACCACACCTATGATTGTTCACTGTAGTGCTGGAGTTGGAAGAACT

GGAGTTTTTATTGCTCTGGACCATTTAACACAACATATAAATGACCATGATTTTGTGGATATATATGGACTA

GTAGCTGAACTGAGAAGTGAAAGAATGTGCATGGTGCAGAATCTGGCACAGTATATCTTTTTACACCAGTGC

ATTCTGGATCTCTTATCAAATAAGGGAAGTAATCAGCCCATCTGTTTTGTTAACTATTCAGCACTTCAGAAG

ATGGACTCTTTGGACGCCATGGAGGTGATGTTGAGCTTGAATGGGAAGAAACCACTATGTAA

---

In a search of public sequence databases, the NOV2c nucleic acid sequence, located on chromsome 12 has 5903 of 6906 bases (85%) identical to a gb:GENBANK-ID:AF063249|acc:AF063249.1 mRNA from *Rattus norvegicus* (*Rattus norvegicus* glomerular mesangial cell receptor protein-tyrosine phosphatase precursor (PTPRQ) mRNA, complete cds) (E=0.0). Public nucleotide databases include all GenBank databases and the GeneSeq patent database.

The disclosed NOV2c polypeptide (SEQ ID NO:10) encoded by SEQ ID NO:9 has 2300 amino acid residues and is presented in Table 2F using the one-letter amino acid code. Signal P, Psort and/or Hydropathy results predict that NOV2c has a signal peptide and is likely to be localized in the plasma membrane with a certainty of 0.4600. In other embodiments, NOV2c may also be localized to the microbody (peroxisome) with acertainty of 0.1260, the endoplasmic reticulum (membrane) with a certainty of 0.1000 or in the endoplasmic reticulum (lumen) with a certainty of 0.1000. The most likely cleavage site for a NOV2c peptide is between amino acids 17 and 18, at: SET-QV.

TABLE 2F

Encoded NOV2c protein sequence.

(SEQ ID NO:10)

MDFLIIFLLLFIGTSETOVDVSNVVPGTRYDITISSISTTYTSPVTRIVTTNVTEPGPPVFLAGERVGSAGI

LLSWNTPPNPNGRIISYIVKYKEVCPWMQTVYTQVRSKPDSLEVLLTNLNPGTTYEIKVAAENSACIGVFSD

PFLFQTAESPAPGKVVNLTVEAYNASAVKLIWYLPRQPNGKITSFKISVKHARSGIVVKDVSIRVEDILTGK

LPECNVENSESFLWSTASPSPTLORVTPPSRTTHSSSTLTQNEISSVWKEPISFVVTHLRPYTTYLFEVSAA

TTEAGYIDSTIVRTPESVPEGPPQNCVTGNITGKSFSILWDPPTIVTGKFSYRVELYGPSGRILDNSTKDLK

FAFTNLTPFTMYDVYIAAETSAGTGPKSNISVFTPPDVPCAVFDLQLAEVESTQVRITWKKPRQPNGIINQY

RVKVLVPETGIILENTLLTGNNEINDPMAPEIVNIVEPMVGLYEGSAEMSSDLHSLATFIYNSHPDKNPPAR

NRAEDQTSPVVTTRNQYITDIAAEQLSYVIRRLVPFTEHMISVSAFTIMGEGPPTVLSVRTRQQVPSSIKII

NYKNISSSSILLYWDPPEYPNGKITHYTIYAMELDTNRAEQITTIDNSFLITGIGLKKYTKYKMRVAASTHV

GESSLSEENDIFVRTSEDEPESSPQDVEVIDVTADEIRLKWSPPEKPNGIIIAYEVLYKNIDTLYMKNTSTT

DIILRNLRPHTLYNISVRSYTRFGHGNQVSSLLSVRTSETVPDSAPENITYKNISSGEIELSFLPPSSPNGI

IQKYTIYLKRSNGNEERTINTTSLTQNILKKYTQYIIEVSASTLKGEGVRSAPISILTEEDAPDSPPQDFSV

KQLSGVTVKLSWQPPLEPNGIILYYTVYVWRNRSSLKTINVTETSLELSDLDYNVEYSAYVTASTRFGDGKT

RSNIISFQTPEGPSDPPKDVYYANLSSSSIILFWTPPSKPNGIILYYSVYYRNTSGTFMQNFTLHEVTNDFD

NMTVSTIIDKLTIFSYYTFWLTASTSVGNGNKSSDIIEVYTDQDVPEGFVGNLTYESISSTAINVSWVPPAQ

PNGLVFYYVSLILQQTPRHVRPPLVTYERSIYFD&LEKYTDYILKITPSTEKGFSDTYTAQLYIKTEEDVPE

TSPIINTFKNLSSTSVLLSWDPPVKPNGAIISYDLTLOGPNENYSFITSDNYIILEELSPFTLYSFFAAART

RKGLGPSSILFFYTDESVPLAPPQNLTLINCTSDFVWLKWSPSPLPGGIVKVYSFKIHEHETDTIYYKNISG

TABLE 2F-continued

Encoded NOV2c protein sequence.

```
FKTEAKLVGLEPVSTYSIRVSAFTKVGNGNOFSNVVKFTTQESVPDVVQNMQCMATSWQSVLVKWDPPKKAN

GIITQYMVTVERNSTKVSPQDHMYTFIKLLANTSYVFKVRASTSAGEGDESTCHVSTLPETVPSVPTNIAFS

DVQSTSATLTWIRPDTILGYFQNYKITTQLRAQKCKEWESEECVEYQKIQYLYEAHLTEETVYGLKKFRWYR

FQVAASTNAGYCNASNWISTKTLPCPPDGPPENVHVVATSPFSISISWSEPAVITCPTCYLIDVKSVDNDEF

NISFIKSNEENKTIEIKDLEIFTRYSVVITAFTGNISAAYVEGKSSAEMIVTTLESAPKDPPNNMTFQKIPD

EVTKFQLTSLPPSQPNCNIQVYQALVYREDDPTAVQIHNLSIIQKTNTFVIANLEGLKGGHTYNISVYAVNS

AGAGPKVPMRITMDIKAPARPKTKPTPIYDATGKLLVTSTTITIRMPICYYSDDHGPIKNVQVLVTETCAQH

DGNVTKWYDAYFNKARPYFTNEGFPNPPCTEGKTKFSGNEEIYIIGADNACMIPCNEDKICNGPLKPKKQYL

FKFRATNIMGQFTDSDYSDPVKTLCECLSERTLEIILSVTLCILSIILLGTAIFAFARIRQKQKEGGTYSPQ

DAEIIDTKLKLDQLITVADLELKDERLTRLLSYRKSIKPISKKSFLQHVEELCTNNNLKFQEEFSELPKFLQ

DLSSTDADLPWNRAKNRFPNIKPYNNNRVKLIADASVPCSDYINASYISCYLCPNEFIATQGPLPQTVCDFW

RMVWETRAKTLVMLTQCFEKGRIRCHQYWPEDNKPVTVFGDIVITKLMEDVQIDWTIRDLKIERHGDCMTVR

QCNFTAWPEHGVPENSAPLIHFVKLVRASRAHDTTPMIVHCSAGVGRTCVFIALDHLTQMINDHDFVDIYGL

VAELRSERMCMVQNLAQYIFLHQCILDLLSNKCSNQPICFVNYSALQKNDSLDAMECDVELEWEETTM
```

A search of sequence databases reveals that the NOV2c amino acid sequence has 1988 of 2301 amino acid residues (86%) identical to, and 2151 of 2301 amino acid residues (93%) similar to, the 2302 amino acid residue ptnr:SPTREMBL-ACC:O88488 protein from *Rattus norvegicus* (Rat) (Glomerular Mesangial Cell Receptor Protein-Tyrosine Phosphatase Precursor (EC 3.1.3.48)) (E=0.0). Public amino acid databases include the GenBank databases, SwissProt, PDB and PIR.

NOV2c is expressed in at least Synovium/Synovial membrane, Kidney. Expression information was derived from the tissue sources of the sequences that were included in the derivation of the sequence of CuraGen Acc. No. CG50718-05. The sequence is predicted to be expressed in the *Rattus norvegicus*:glomerular mesangial. because of the expression pattern of (GENBANK-ID: gb:GENBANK-ID:AF063249|acc:AF063249.1) a closely related *Rattus norvegicus* glomerular mesangial cell receptor protein-tyrosine phosphatase precursor (PTPRQ) mRNA, complete cds homolog.

Homologies among each of the above NOV2 proteins will be shared by the other NOV2 proteins insofar as they are homologous to each other as shown below in Table 2G. Any reference to NOV2 is assumed to refer to all three of the NOV2 proteins in general, unless otherwise noted.

TABLE 2G

Alignment of NOV2a, b, and c

```
                10        20        30        40        50        60
       ....|....|....|....|....|....|....|....|....|....|....|....|
NOV2a  MDFLIIFLLLFIGTSETQVDVSNVVPGTRYDITISSISTTYTSPVTRIGASN--EPGPPV  58
NOV2b  ------------------------------------------------------------  1
NOV2c  MDFLIIFLLLFIGTSETQVDVSNVVPGTRYDITISSISTTYTSPVTRIVTINVTEPGPPV  60

70        80        90       100       110       120
       ....|....|....|....|....|....|....|....|....|....|....|....|
NOV2a  FLAGERVGSAGILLSWNTPPNPNGRIISYIVKYKEVCPWMQTVYTQVRSKPDSLEVLLTN  118
NOV2b  ------------------------------------------------------------  1
NOV2c  FLAGERVGSAGILLSWNTPPNPNGRIISYIVKYKEVCPWMQTVYTQVRSKPDSLEVLLTN  120

130       140       150       160       170       180
       ....|....|....|....|....|....|....|....|....|....|....|....|
NOV2a  LNPGTTYEIKVAAENSAGIGVFSDPFLFQTAES-APGKVVDFIGEAVPFSS-KLMWYTS-  175
NOV2b  ------------------------------------------------------------  1
NOV2c  LNPGTTYEIKVAAENSAGIGVFSDPFLFQTAESPAPGKVVMLIVEAYNASAVKLINYLPR  180

190       200       210       220       230       240
       ....|....|....|....|....|....|....|....|....|....|....|....|
NOV2a  ATKKKITSFKISVKHNRSGIVVKSVSIRVECIISASLPLHCNENSESFLWSTASPSPTLG  235
NOV2b  ------------------------------------------------------------  1
NOV2c  QPNGKITSFKISVKHARSGIVVKDVSIRVEDILTGKLPECNVENSESFLWSTASPSPTLG  240
```

TABLE 2G-continued

Alignment of NOV2a, b, and c

```
              250        260        270        280        290        300
          ....|....|....|....|....|....|....|....|....|....|....|....|
NOV2a     RVTPPSRITHSSSTLTQNEISSV-KEPISFVVTHLRPYTTYLFEVSAATTEAGYIDSTIV  294
NOV2b     ------------------------------------------------------------  1
NOV2c     RVTPPSRITHSSSTLTQNEISSVWKEPISFVVTHLRPYTTYLFEVSAATTEAGYIDSTIV  300

310        320        330        340        350        360
          ....|....|....|....|....|....|....|....|....|....|....|....|
NOV2a     RTPESVPEGPPQNCVTGNITGKSFSILWDPPTIVTGKFSYRVELYGPSAGRILDNSTKDL  354
NOV2b     ------------------------------------------------------------  1
NOV2c     RTPESVPEGPPQNCVTGNITGKSFSILWDPPTIVTGKFSYRVELYGP-SGRILDNSTKDL  359

370        380        390        400        410        420
          ....|....|....|....|....|....|....|....|....|....|....|....|
NOV2a     KFAFTNLTPFTMYDVYIAAETSAGTGPKSNISVFTPPDVPGAVFDLQLAEVESTQVRITW  354
NOV2b     ------------------------------------------------------------  1
NOV2c     KFAFTNLTPFTMYDVYIAAETSAGTGPKSNISVFTPPDVPGAVFDLQLAEVESTQVRITW  359

430        440        450        460        470        480
          ....|....|....|....|....|....|....|....|....|....|....|....|
NOV2a     KKPRQPNGIINQYRVKVLVPETGIILENTLLTGNNEINDPMAPEIVNIVQPMVGLYEGSA  474
NOV2b     ------------------------------------------------------------  1
NOV2c     KKPRQPNGIINQYRVKVLVPETGIILENTLLTGNNEINDPMAPEIVNIVEPMVGLYEGSA  479

490        500        510        520        530        540
          ....|....|....|....|....|....|....|....|....|....|....|....|
NOV2a     EMSSDLHSLATFIYNSHPDKNFPARNRAEDQTSPVVTTRNQYITDIAAWQLRYVLIRLRR  534
NOV2b     ------------------------------------------------------------  1
NOV2c     EMSSDLHSLATFIYNSHPDKNFPARNRAEDQTSPVVTTRNQYITDIAAWQLRYVLIRLRR  539

550        560        570        580        590        600
          ....|....|....|....|....|....|....|....|....|....|....|....|
NOV2a     EWAETMGFSRYTIMSSASRDNLTSPG----PLSAQNFRVTHVTITEVFLRWDPPD--PVF  588
NOV2b     ------------------------------------------------------------  1
NOV2c     ETEHMISVSARTIMGEGPPTVLSVRTRQQVESSIKIINYKNISSSSILLYWDPPEYPNGK  599

610        620        630        640        650        660
          ....|....|....|....|....|....|....|....|....|....|....|....|
NOV2a     FHHYLITILDVENQSKSIILRTLNSLSLVLIGLKKYTKYKMRVAASTHVGESSLSEENDI  648
NOV2b     ------------------------------------------------------------  1
NOV2c     ITHYTTYAMELDTNRAFQTTTIDNSFLITGIGLKKYTKYKMRVAASTHVGESSLSEENDI  659

670        680        690        700        710        720
          ....|....|....|....|....|....|....|....|....|....|....|....|
NOV2a     FVRTSEDEPESSPQDVEVIDVTADEIRLKWSPPEKPNGIIIAYEVLYKNIDTLYMKNTST  708
NOV2b     ------------------------------------------------------------  1
NOV2c     FVRTSEDEPESSPQDVEVIDVTADEIRLKWSPPEKPNGIIIAYEVLYKNIDTLYMKNTST  719

730        740        750        760        770        780
          ....|....|....|....|....|....|....|....|....|....|....|....|
NOV2a     TDIILRNLRPHTLYNISVRSYTRFGHGNQVSSLLSVTRSESVPDSAPENITYKNISSGEI  768
NOV2b     ------------------------------------------------------------  1
NOV2c     TDIILRNLRPHTLYNISVRSYTRFGHGNQVSSLLSVTRSEAVPDSAPENITYKNISSGEI  779

790        800        810        820        830        840
          ....|....|....|....|....|....|....|....|....|....|....|....|
NOV2a     ELSFLPPSSPNGIIQKYTIYLKRSNGNEERTINTTSLTQNIKGLKKYTQYIIEVSASTLK  828
NOV2b     ------------------------------------------------------------  1
NOV2c     ELSFLPPSSPNGIIQKYTIYLKRSNGNEERTINTTSLTQNIKGLKKYTQYIIEVSASTLK  837

850        860        870        880        890        900
          ....|....|....|....|....|....|....|....|....|....|....|....|
NOV2a     GEGVRSAPISILTEEDAPDSPPQDFSVKQLSGVTVKLSWQPPLEPNGIILYYTVYVWR--  886
NOV2b     ------------------------------------------------------------  1
NOV2c     GEGVRSAPISILTEEDAPDSPPQDFSVKQLSGVTVKLSWQPPLEPNGIILYYTVYVWRNR  897

910        920        930        940        950        960
          ....|....|....|....|....|....|....|....|....|....|....|....|
NOV2a     SSLKTINVTETSLELSDLDYNVEYSAYVTASTRFGDKTRSNIISFQTPEGPSDPPKDVY  946
NOV2b     -----------------------------------------------------------  1
NOV2c     SSLKTINVTETSLELSDLDYNVEYSAYVTASTRFGDKTRSNIISFQTPEGPSDPPKDVY  957
```

TABLE 2G-continued

Alignment of NOV2a, b, and c

```
              970       980       990      1000      1010      1020
              ....|....|....|....|....|....|....|....|....|....|....|....|
NOV2a  YANLSSSSIILFWTPPSKPNGIIQYYSVYYRNTSGTFMQNFTLHEVTNDFDNMTVSTIID 1006
NOV2b  ------------------------------------------------------------ 1
NOV2c  YANLSSSSIILFWTPPSKPNGIIQYYSVYYRNTSGTFMQNFTLHEVTNDFDNMTVSTIID 1017

1030      1040      1050      1060      1070      1080
              ....|....|....|....|....|....|....|....|....|....|....|....|
NOV2a  KLTIFSYYTFWLTASTSVGNGNKSSDIIEVYTDQDVPEGFVGNLTYESISSTAINVSWVP 1066
NOV2b  ----------------------RS------------PEGFVGNLTYESISSTAINVSWVP 26
NOV2c  KLTIFSYYTFWLTASTSVGNGNKSSDIIEVYTDQDVPEGFVGNLTYESISSTAINVSWVP 1077

1090      1100      1110      1120      1130      1140
              ....|....|....|....|....|....|....|....|....|....|....|....|
NOV2a  PAQPNGLVFYYVSLILQQTPRHVRPPLVTYERSIYFDNLEKYTDYILKITPSTEKGFSDT 1126
NOV2b  PAQPNGLVFYYVSLILQQTPRHVRPPLVTYERSIYFDNLEKYTDYILKITPSTEKGFSDT 86
NOV2c  PAQPNGLVFYYVSLILQQTPRHVRPPLVTYERSIYFDNLEKYTDYILKITPSTEKGFSDT 1137

1150      1160      1170      1180      1190      1200
              ....|....|....|....|....|....|....|....|....|....|....|....|
NOV2a  YTAQLYIKTEEDIPETSPIINTFKNLSSTSVLLSWDPPVKPNGAIISYDLTLQGPNENYS 1186
NOV2b  YTAQLYIKTEEDVPETSPIINTFKNLSSTSVLLSWDPPVKPNGAIISYDLTLQGPNENYS 146
NOV2c  YTAQLYIKTEEDIPETSPIINTFKNLSSTSVLLSWDPPVKPNGAIISYDLTLQGPNENYS 1197

1210      1220      1230      1240      1250      1260
              ....|....|....|....|....|....|....|....|....|....|....|....|
NOV2a  FITSDNYIILEELSPFTLYSFFAAARTRKGLGPSSILFFYTDESVPLAPPQNLTLINCTS 1246
NOV2b  FITSDNYIILEELSPFTLYSFFAAARTRKGLGPSSILFFYTDESVPLAPPQNLTLINCTS 206
NOV2c  FITSDNYIILEELSPFTLYSFFAAARTRKGLGPSSILFFYTDESVPLAPPQNLTLINCTS 1257

1270      1280      1290      1300      1310      1320
              ....|....|....|....|....|....|....|....|....|....|....|....|
NOV2a  DFVWLKWSPSPLPGGIVKVYSFKIHEHETDTIYYKNISGFKTEAKLVGLEPVSTYSIRVS 1306
NOV2b  DFVWLKWSPSPLPGGIVKVYSFKIHEHETDTIYYKNISGFKTEAKLVGLEPVSTYSIRVS 266
NOV2c  DFVWLKWSPSPLPGGIVKVYSFKIHEHETDTIYYKNISGFKTEAKLVGLEPVSTYSIRVS 1317

1330      1340      1350      1360      1370      1380
              ....|....|....|....|....|....|....|....|....|....|....|....|
NOV2a  AFTKVGNGNQFSNVVKFTTQESVPDVVQNMQCMATSWQSVLVKWDPPKKANGIITQYMVT 1366
NOV2b  AFTKVGNGNQFSNVVKFTTQESVPDVVQNMQCMATSWQSVLVKWDPPKKANGIITQYMVT 326
NOV2c  AFTKVGNGNQFSNVVKFTTQESVPDVVQNMQCMATSWQSVLVKWDPPKKANGIITQYMVT 1377

1390      1400      1410      1420      1430      1440
              ....|....|....|....|....|....|....|....|....|....|....|....|
NOV2a  VERNSTKVSPQDHMYTFIKLLANTSYVFKVRASTSAGEGDESTCHVSTLPETVPSVPTNI 1426
NOV2b  VERNSTKVSPQDHMYTFIKLLANTSYVFKVRASTSAGEGDESTCHVSTLPETVPSVPTNI 386
NOV2c  VERNSTKVSPQDHMYTFIKLLANTSYVFKVRASTSAGEGDESTCHVSTLPETVPSVPTNI 1437

1450      1460      1470      1480      1490      1500
              ....|....|....|....|....|....|....|....|....|....|....|....|
NOV2a  AFSDVQSTSATLTWIRPDTILGYFQNYKITTQLRAQKCKEWESEECVEYQKIQYLYEAHL 1486
NOV2b  AFSDVQSTSATLTWIRPDTILGYFQNYKITTQLRAQKCKEWESEECVEYQKIQYLYEAHL 446
NOV2c  AFSDVQSTSATLTWIRPDTILGYFQNYKITTQLRAQKCKEWESEECVEYQKIQYLYEAHL 1497

1510      1520      1530      1540      1550      1560
              ....|....|....|....|....|....|....|....|....|....|....|....|
NOV2a  TEETVYGLKKFRWYRFQVAASTNAGYGNASNWISTKTLPGPPDGPPENVHVVATSPFSIS 1546
NOV2b  TEETVYGLKKFRWYRFQVAASTNAGYGNASNWISTKTLPGPPDGPPENVHVVATSPFSIS 506
NOV2c  TEETVYGLKKFRWYRFQVAASTNAGYGNASNWISTKTLPGPPDGPPENVHVVATSPFSIS 1557

1570      1580      1590      1600      1610      1620
              ....|....|....|....|....|....|....|....|....|....|....|....|
NOV2a  ISWSEPAVITGPTCYLIDVKSVDNDEFNISFIKSNEENKTIEIKDLEIFTRYSVVITAFT 1606
NOV2b  ISWSEPAVITGPTCYLIDVKSVDNDEFNISFIKSNEENKTIEIKDLEIFTRYSVVITAFT 566
NOV2c  ISWSEPAVITGPTCYLIDVKSVDNDEFNISFIKSNEENKTIEIKDLEIFTRYSVVITAFT 1617

1630      1640      1650      1660      1670      1680
              ....|....|....|....|....|....|....|....|....|....|....|....|
NOV2a  GNISAAYVEGKSSAEMIVTTLESAPKDPPNNMTFQKIPDEVTKFQLTFLPPSQPNGNIQV 1666
NOV2b  GNISAAYVEGKSSAEMIVTTLESAPKDPPNNMTFQKIPDEVTKFQLTSLPPSQPNGNIQV 626
NOV2c  GNISAAYVEGKSSAEMIVTTLESAPKDPPNNMTFQKIPDEVTKFQLTSLPPSQPNGNIQV 1677
```

TABLE 2G-continued

Alignment of NOV2a, b, and c

```
              1690       1700       1710       1720       1730       1740
               ....|....|....|....|....|....|....|....|....|....|....|....|
NOV2a  YQALVYREDDPTAVQIHNLSIIQKTNTFVIAMLEGLKGGHTYNISVYAVNSAGAGPKVPM  1726
NOV2b  YQALVYREDDPTAVQIHNLSIIQKTNTFVIAMLEGLKGGHTYNISVYAVNSAGAGPKVPM   686
NOV2c  YQALVYREDDPTAVQIHNLSIIQKTNTFVIAMLEGLKGGHTYNISVYAVNSAGAGPKVPM  1737

1750       1760       1770       1780       1790       1800
               ....|....|....|....|....|....|....|....|....|....|....|....|
NOV2a  RITMDIKAPARPKTKPTPIYDATGKLLVTSTTITIRMPICYYSDDHGPIKNVQVLVTETG  1786
NOV2b  RITMDIKAPARPKTKPTPIYDATGKLLVTSTTITIRMPICYYSDDHGPIKNVQVLVTETG   746
NOV2c  RITMDIKAPARPKTKPTPIYDATGKLLVTSTTITIRMPICYYSDDHGPIKNVQVLVTETG  1797

1810       1820       1830       1840       1850       1860
               ....|....|....|....|....|....|....|....|....|....|....|....|
NOV2a  AQHDGNVTKWYDAYFNKARPYFTNEGFPNPPCTEGKTKFSGNEEIYIIGADNACMIPGNE  1846
NOV2b  AQHDGNVTKWYDAYFNKARPYFTNEGFPNPPCTEGKTKFSGNEEIYIIGADNACMIPGNE   806
NOV2c  AQHDGNVTKWYDAYFNKARPYFTNEGFPNPPCTEGKTKFSGNEEIYIIGADNACMIPGNE  1857

1870       1880       1890       1900       1910       1920
               ....|....|....|....|....|....|....|....|....|....|....|....|
NOV2a  DKICNGPLKPKKQYLFKFRATNIMGQFTDSDYSDPVKTLGEGLSERTVEIILSVTLCILS  1906
NOV2b  DKICNGPLKPKKQYLFKFRATNIMGQFTDSDYSDPVKTLGEGLSERTLE-----------   855
NOV2c  DKICNGPLKPKKQYLFKFRATNIMGQFTDSDYSDPVKTLGEGLSERTLEIILSVTLCILS  1917

1930       1940       1950       1960       1970       1980
               ....|....|....|....|....|....|....|....|....|....|....|....|
NOV2a  IILLGTAIFAFARIRQKQKEGGTYSPQDAEIIDTKLKLDQLITVADLELKDERLTR----  1962
NOV2b  ------------------------------------------------------------   855
NOV2c  IILLGTAIFAFARIRQKQKEGGTYSPQDAEIIDTKLKLDQLITVADLELKDERLTRLLSY  1977

1930       1940       1950       1960       1970       1980
               ....|....|....|....|....|....|....|....|....|....|....|....|
NOV2a  -----PISKKSFLQHVEELCTNNNLKFQEEFSELPKFLQDLSSTDADLPWNRAKNRFPNI  2017
NOV2b  ------------------------------------------------------------   855
NOV2c  RKSIKPISKKSFLQHVEELCTNNNLKFQEEFSELPKFLQDLSSTDADLPWNRAKNRFPNI  2037

1990       2000       2010       2020       2030       2040
               ....|....|....|....|....|....|....|....|....|....|....|....|
NOV2a  KPYNNNRVKLIADASVPGSDYINASYISGYLCPNEFIATQGPLPGTVGDFWRMVWETRAK  2077
NOV2b  ------------------------------------------------------------   855
NOV2c  KPYNNNRVKLIADASVPGSDYINASYISGYLCPNEFIATQGPLPGTVGDFWRMVWETRAK  2097

2110       2120       2130       2140       2150       2160
               ....|....|....|....|....|....|....|....|....|....|....|....|
NOV2a  TLVMLTQCFEKGRIRCHQYWPEDNKPVTVFGDIVITKLMEDVQIDWTIRDLKIERHGDCM  2137
NOV2b  ------------------------------------------------------------   855
NOV2c  TLVMLTQCFEKGRIRCHQYWPEDNKPVTVFGDIVITKLMEDVQIDWTIRDLKIERHGDCM  2157

2170       2180       2190       2200       2210       2220
               ....|....|....|....|....|....|....|....|....|....|....|....|
NOV2a  TVRQCNFTAWPEHGVPENSAPLIHFVKLVRASRAHDTTPMIVHCSAGVGRTGVFIALDHL  2197
NOV2b  ------------------------------------------------------------   855
NOV2c  TVRQCNFTAWPEHGVPENSAPLIHFVKLVRASRAHDTTPMIVHCSAGVGRTGVFIALDHL  2217

2230       2240       2250       2260       2270       2280
               ....|....|....|....|....|....|....|....|....|....|....|....|
NOV2a  TQHINDHDFVDIYGLVAELRSERMCMVQNLAQYIFLHQCILDLLSNKGSNQPICFVNYSA  2257
NOV2b  ------------------------------------------------------------   855
NOV2c  TQHINDHDFVDIYGLVAELRSERMCMVQNLAQYIFLHQCILDLLSNKGSNQPICFVNYSA  2277

2290       2300
               ....|....|....|....
NOV2a  LQKMDSLDAMEGGDVELEWEERRM  2281  (SEQ ID NO:6)
NOV2b  ------------------------   855  (SEQ ID NO:8)
NOV2c  LQKMDSLDAMEG-DVELEWEERRM  2300  (SEQ ID NO:10)
```

The disclosed NOV2a polypeptide has homology to the amino acid sequences shown in the BLASTP data listed in Table 2H.

TABLE 2H

BLAST results for NOV2a

| Gene Index/ Identifier | Protein/Organism | Length (aa) | Identity (%) | Positives (%) | Expect |
|---|---|---|---|---|---|
| gi\|12621078\|ref\|NP_075214.1\| (NM_022925) | protein tyrosine phosphatase, receptor type, Q [*Rattus norvegicus*] | 2302 | 1893/2306 (82%) | 2077/2306 (89%) | 0.0 |
| gi\|125977\|sp\|P16621\|LAR_DROME | PROTEIN-TYROSINE PHOSPHATASE DLAR PRECURSOR (PROTEIN-TYROSINE-PHOSPHATE PHOSPHOHYDROLASE) | 2029 | 410/1587 (25%) | 680/1587 (42%) | 1e-94 |
| gi\|10728878\|gb\|AAF53837.2\| (AE003663) | Lar gene product [*Drosophila melanogaster*] | 2037 | 410/1587 (25%) | 680/1587 (42%) | 2e-94 |
| gi\|7290546\|gb\|AAF5998.1\| (AE003432) | Ptp4E gene product [*Drosophila melanogaster*] | 1767 | 417/1645 (25%) | 694/1645 (41%) | 8e-94 |
| gi\|1362625\|pir\|\|A49502 | protein-tyrosine-phosphatase (EC 3.1.3.48), receptor type 4E, splice form A precursor - fruit fly (*Drosophila melanogaster*) | 1767 | 416/1645 (25%) | 693/1645 (41%) | 1e-92 |

The homology between these and other sequences is shown graphically in the ClustalW analysis shown in Table 2I. In the ClustalW alignment of the NOV2 proteins, as well as all other ClustalW analyses herein, the black outlined amino acid residues indicate regions of conserved sequence (i.e., regions that may be required to preserve structural or functional properties), whereas non-highlighted amino acid residues are less conserved and can potentially be altered to a much broader extent without altering protein structure or function.

TABLE 2I

ClustalW Analysis of NOV2

1) Novel NOV2a (SEQ ID NO:6)
2) gi|12621078|ref|NP_075214.1| (NM_022925) protein tyrosine phosphatase, receptor.type, Q [*Rattus norvegicus*] (SEQ ID NO:37)
3) gi|125977|sp|P16621|LAR_DROME PROTEIN-TYROSINE PHOSPHATASE DLAR PRECURSOR (PROTEIN-TYROSINE-PHOSPHATE PHOSPHOHYDROLASE) (SEQ ID NO:38)
4) gi|10728878|gb|AAF53837.2| (AE003663) Lar gene product [*Drosophila melanogaster*] (SEQ ID NO:39)
5) gi|7290546|gb|AAF45998.1| (AE003432) Ptp4E gene product [*Drosophila melanogaster*] (SEQ ID NO:40)
6) gi|1362625|pir||A49502 protein-tyrosine-phosphatase (EC 3.1.3.48), receptor type 4E, splice form A precursor - fruit fly (*Drosophila melanogaster*) (SEQ ID NO:41)

```
                        10         20         30         40         50
                 ....|....|....|....|....|....|....|....|....|....|
NOV2A        -MDFLIIFLLLFIGLSETQYDVSNVVPGTRYDILISSIS--TTYTSPVTR
gi|12621078| MMDFHFSFLFLLIGLSESQVDVSSSFDGTGYDILLSSVSA-TTYSSPVSR
gi|125977|   --------MGLQMLAARPIAALSLLVLSLLTWLHPTIVDAAHPPEIIRK
gi|10728878| --------MGLQMLAARPIAALSLLVLSLLTWLHPTIVDAAHPPEIIRK
gi|7290546|  -MDCATRKQQQLRAHHQQQQIQIQTHGRKRQQLQKQRHNHHHYYQNSQQQ
gi|1362625|  -MDCATRKQQQLRAHHQQQQIQIQTHGRKRQQLQKQRHNHHHYYQNPQQQ
```

TABLE 2I-continued

ClustalW Analysis of NOV2

```
              60         70         80         90        100
            ....|....|....|....|....|....|....|....|....|....|
NOV2A       IGAS--NEPGPPVELAGERVGSAGILLSWNTPNPNCRIISYIVKYKEVC
gi|12621078|TLATNVTKPCPPVELAGERVGSAGILLSWNTPNPNCRIISYVYKYKEVC
gi|125977|  PQNQGVRVGCVASEYCAARGDPPPSIVWRKNGKKVSC-----------
gi|10728878|PQNQGVRVGCVASEYCAARGDPPPSIVWRKNGKKVSC-----------
gi|7290546| QKHFVWLVVGILTIFLAQHANAADLVI--NVENASSNANAFYRIDYSPPF
gi|1362625| QKHFVWLVVGILTIFLARHANAADLVI--NVENASSNANAFYRIDYSPPF 110        120        130        140        150
            ....|....|....|....|....|....|....|....|....|....|
NOV2A       PWMQTVYIQVRSKPDSLEVLLTNLNPGTTYEIKVAAENSAGIGVFSDPFL
gi|12621078|PWMQTAYTRARAKPDSLEVLLTNLNPGTTYEIKVAAENNAGIGVFSDPFL
gi|125977|  -T-QSRYTVLEQPGGISILRIEPVRAGRDDAPYECVAENGVGDAVSADAT
gi|10728878|-T-QSRYTVLEQPGGISILRIEPVRAGRDDAPYECVAENGVGDAVSADAT
gi|7290546| GFPEPNTTIPASDIG-KDIKFSRALPGTEYNFWLYYTNSTHREQLTWTVN
gi|1362625| GFPEPNTTIPASDIG-KDIKFSRALPGTEYNFWLYYTNSTHREQLTWTVN 160        170        180        190        200
            ....|....|....|....|....|....|....|....|....|....|
NOV2A       FQTAESAPGKVVDFIGEAVPFSSK-LMWYTS-ATKKKITSFKISVKHNRS
gi|12621078|FQTAESAPGKVVNLIVEALNYSAVNLIWYLPRQPNGKITSFKISVKHARS
gi|125977|  LTIYE----------GDKTPAGFPVITQGPGTRVIEVGHTVLMTVKAIG
gi|10728878|LTIYEGWQ---KTAISGDKTPAGFPVITQGPGTRVIEVGHTVLMTCKAIG
gi|7290546| ITTAPDPE---ANLSVQLRSSKSAFITWRPP--GSGRYSGFRIRVLGLTD
gi|1362625| ITTAPDPE---ANLSVQLRSSKSAFITWRPP--GSGRYSGFRIRVLGLTD 210        220        230        240        250
            ....|....|....|....|....|....|....|....|....|....|
NOV2A       GIVVKEVSIRVECILSASLPLHCNENSESPLWSTASPSPTLGRVTPPSRT
gi|12621078|GIVVKDVSLRVEDILSGKLP-ECNENSESPLWSTTSPSPTLGRVTPTVRT
gi|125977|  NPTPNIYWIKNQTKVDMSNPRYSLKDGFLQIENSREEDQGKYECVAENSM
gi|10728878|NPTPNIYWIKNQTKVDMSNPRYSLKDGFLQIENSREEDQGKYECVAENSM
gi|7290546| LPFERSYSLEGNETLQLSAK--ELTPGGSYQVQAYSVYQGKESVAYTSRN
gi|1362625| LPFERSYSLEGNETLQLSAK--ELTPGGSYQVQAYSVYQGKESVAYTSRN 260        270        280        290        300
            ....|....|....|....|....|....|....|....|....|....|
NOV2A       THSSSTLTQNETSSV-KEEISFVVTHLRPYTTYLFEVSAATTEAGYIDST
gi|12621078|TQSSSTAARSKISSVWKEEISFVVTHLRPYTTYLFEVSAVTTEAGYIDST
gi|125977|  GTEHSKATNLYVKVRRVPETFSRPPETISEVMLGSNLNLSCIAVGSPMPH
gi|10728878|GTEHSKATNLYVKVRRVPETFSRPPETISEVMLGSNLNLSCIAVGSPMPH
gi|7290546| FTTKPNTPGKFIVWFRNETILLVLWQPPFPAGIYTHYRVSITPDDATQSV
gi|1362625| FTTKPNTPGKFIVWFRNETILLVLWQPPFPAGIYTHYRVSITPDDATQSV 310        320        330        340        350
            ....|....|....|....|....|....|....|....|....|....|
NOV2A       IVRTPESVPEGPPQNCVTGNITGKSFSTLWDPPTIVTGKFSYRVELYGPS
gi|12621078|IVRTPESVPEGPPQNCIMCNVTGKSFSISWDPPTIVTGKFSYRVELYGP-
gi|125977|  VKWMKGSEDLTPENEMPICRNVLQLINIQESAN----------------
gi|10728878|VKWMKGSEDLTPENEMPICRNVLQLINIQESAN----------------
gi|7290546| LYVEREGEPPGPACAAFKCLVPGREYNISVQT-----------------
gi|1362625| LYVEREGEPPGPACAAFKCLVPGREYNISVQT-----------------

360        370        380        390        400
            ....|....|....|....|....|....|....|....|....|....|
NOV2A       AGRILDNSTKDLKFAFTNLTPFTMYDVYLAAETSAGTGPKSNISVFTPPD
gi|12621078|SGRILDNSTKDLRFAFTHLTPFTMYDVYVAAETSAGVGPKSNLSVFTPPD
gi|125977|  ---------------------------YICIAASTLGQIDSVSVVKVQS
gi|10728878|---------------------------YICIAASTLGQIDSVSVVKVQS
gi|7290546| ---------------------------VSEDETS-SVPTTARYLTVEER
gi|1362625| ---------------------------VSEDETS-SVPTTARYLTVEER 410        420        430        440        450
            ....|....|....|....|....|....|....|....|....|....|
NOV2A       VPGAVEDLQLAEVESTQVRITWKKPRQPNGIINQYRVEVLVPETGIILEN
gi|12621078|VPGAVEDLQLAEVEATEIRITWRKPRQPNGIISQYRVKVSVLETGVVLEN
gi|125977|  LPTAPTDVQISEVTALSVRLEWSYKG-------PEDLQYYVIQYKPKNAN
gi|10728878|LPTAPTDVQISEVTALSVRLEWSYKG-------PEDLQYYVIQYKPKNAN
gi|7290546| VLNVTFDEAYTTSSS--FRVRWEPPR----TYSEFDAYQVMLSTSRRIFN
gi|1362625| VLNVTFDEAYTTSSS--FRVRWEPPR----TYSEFDAYQVMLSTSRRIFN 460        470        480        490        500
            ....|....|....|....|....|....|....|....|....|....|
NOV2A       TLLTGNNE-INDPMAPEIVNIVQEMVGLYEGSAEMSSDLHSLATFIYNSH
gi|12621078|TLLTGQDESISNPMSPEIMNLVDEMIGFYEGSGEMSSDLHSPASFIYNSH
gi|125977|  QAFSEISG---IITMYYVVRALSEYTEYEFYVIAVNNIGRG---------
gi|10728878|QAFSEISG---IITMYYVVRALSEYTEYEFYVIAVNNIGRG---------
gi|7290546| VPRAANGD----SVYFDYPDILEEGRTYEVVKTIADNVN-----------
gi|1362625| VPRAANGD----SVYFDYSDILEEGRTYEVVKTIADNVN-----------
```

TABLE 2I-continued

ClustalW Analysis of NOV2

```
                   510        520        530        540        550
              ....|....|....|....|....|....|....|....|....|....|
NOV2A         PDKNFPARNRAEDQTSPVVITRNQYITDIAAEQLTYVLIRLRRFWAETMG
gi|12621078|  PHNDFPASTRAEEQSSPVVITRNQYMTDITAEQLSYVVRRLVPFTEHTIS
gi|125977|    -----PPSAPATCTIGETKMESAP--------------------------
gi|10728878|  -----PPSAPATCTIGETKMESAP--------------------------
gi|7290546|   ---SWPASGEVTLRPRPVRSLG----------------------------
gi|1362625|   ---SWPASGEVTLRPRPVRSLG----------------------------

560        570        580        590        600
              ....|....|....|....|....|....|....|....|....|....|
NOV2A         FSRYTIMSSASRDNLTSPG----PLSAQNFRVTHVTIIEVFLHWQPPPV
gi|12621078|  VSAFTIMGEGPPTVLTVRTREQVPSSIQIINYKNISSSSILLYWQPPEYP
gi|125977|    --------------------------RNVQVRTLSSSTMVITWEPPETP
gi|10728878|  --------------------------RNVQVRTLSSSTMVITWEPPETP
gi|7290546|   --------------------------GFLDDR---SNALHISWEPAETG
gi|1362625|   --------------------------GFLDDR---SNALHISWEPAETG 610        620        630        640        650
              ....|....|....|....|....|....|....|....|....|....|
NOV2A         FFHHYLITILDVENQSKS----IILRTLNSLSLVIIGLKKYTKYKMRVAA
gi|12621078|  NGKITHYTIYATELDTNR----AFQMTTVDNSFLITGLKKYTRYKMRVAA
gi|125977|    NGQVTGYKVYYTTNSNQPEASWNSQMVDNSELTTVSDVTPHAIYTVRVQA
gi|10728878|  NGQVTGYKVYYTTNSNQPEASWNSQMVDNSELTTVSELTPHAIYTVRVQA
gi|7290546|   TQDSYRISYHEQTNASEV----PAPFPVAAESQITTNLTEYTLDSLLAGR
gi|1362625|   TQDSYRISYHEQTNASEV----PAPFPVAAESQITTNLTEYTLDSLLAGR 660        670        680        690        700
              ....|....|....|....|....|....|....|....|....|....|
NOV2A         STHYGESSLSEENDIFVRTSEDEPESSPQDVEVIDVTADEIRLKWSPPEK
gi|12621078|  STHYGESSLSEENDIFVRTPEDEPESSPQDVQVTGVSPSELRLKWSPPEK
gi|125977|    YLSMGAGPMSTP--------------------------------------
gi|10728878|  YLSMGAGPMSTP--------------------------------------
gi|7290546|   RYLIAVQALSKG--------------------------------------
gi|1362625|   RYLIAVQALSKG--------------------------------------

710        720        730        740        750
              ....|....|....|....|....|....|....|....|....|....|
NOV2A         PNGIIIAYEVLYKNIDTLYMKNTSTTDIILRNLRPHTLYNISVRSYTRFG
gi|12621078|  PNGIIIAYEVLYQNADTLFVKNTSTTDIIISDLKPYTLYNISIRSYTRLG
gi|125977|    ------------------------VQVKAQQGVP----------------
gi|10728878|  ------------------------VQVKAQQGVP----------------
gi|7290546|   ------------------------VASNASDIT---------R-YTRP-
gi|1362625|   ------------------------VASNASDIT---------R-YTRP- 760        770        780        790        800
              ....|....|....|....|....|....|....|....|....|....|
NOV2A         HGNQVSSLLSVTYSESVPDSAPENITYKNISSGEIELSFLPESSENGIIQ
gi|12621078|  HGNQSSSLLSVTYSETVPDSAPENITYKNISSGEIEISFLPERSENGIIQ
gi|125977|    --------------------SQPSNFRATDIGETAMTIQWTKETHSSENIV
gi|10728878|  --------------------SQPSNFRATDIGETAMTIQWTKETHSSENIV
gi|7290546|   --------------------AAPLIQELRSIDQG---IMLSQRSDVNSRQD
gi|1362625|   --------------------AAPLIQELRSIDQG---IMLSQRSDVNSRQD 810        820        830        840        850
              ....|....|....|....|....|....|....|....|....|....|
NOV2A         KYTEYLKRSNG-NEERTINTTSLTQNIKGLKKYTQYIIEVSASTLKGEGV
gi|12621078|  KYTEYLKRSNS-HEARTINTTSLTQTIIGLKKYTHYVIRVSASTLKGEGI
gi|125977|    HYELYWNDIYANQAHHKRISNSEAYTLDGLYEDTLYYIWLAARSQRGEGA
gi|10728878|  HYELYWNDIYANQAHHKRISNSEAYTLDGLYEDTLYYIWLAARSQRGEGA
gi|7290546|   RYEVHYQRNGT-REERTMATNETSLTIHYLHPGSGYEVKVHAISH---GV
gi|1362625|   RYEVHYQRNGT-REERTMATNETSLTIHYLHPGSGYEVKVHAISH---GV 860        870        880        890        900
              ....|....|....|....|....|....|....|....|....|....|
NOV2A         RSAPISILIEEDAPDSPPQDFSVKQLSGVTVKLSWQPP--LEPNCIILYY
gi|12621078|  RSRPISILIEEDAPDSPPQNFSVKQLSGVTVMLSWQPP--LEPNCIILYY
gi|125977|    TTPPIPVRIKQYVEGAPPRNITAIATSSTTISLSWLPPPVERSNGRIIYY
gi|10728878|  TTPPIPVRIKQYVEGAPPRNITAIATSSTTISLSWLPPPVERSNGRIIYY
gi|7290546|   RSEPHSYFQAVFP--KPPQNLTLQTVHTNLVVLHWQAP--EGSD-FSEYV
gi|1362625|   RSEPHSYFQAVFP--KPPQNLTLQTVHTNLVVLHWQAP--EGSD-FSEYV 860        870        880        890        900
              ....|....|....|....|....|....|....|....|....|....|
NOV2A         RSAPISILIEEDAPDSPPQDFSVKQLSGVTVKLSWQPP--LEPNCIILYY
gi|12621078|  RSRPISILIEEDAPDSPPQNFSVKQLSGVTVMLSWQPP--LEPNCIILYY
gi|125977|    TTPPIPVRIKQYVEGAPPRNITAIATSSTTISLSWLPPPVERSNGRIIYY
gi|10728878|  TTPPIPVRIKQYVEGAPPRNITAIATSSTTISLSWLPPPVERSNGRIIYY
gi|7290546|   RSEPHSYFQAVFP--KPPQNLTLQTVHTNLVVLHWQAP--EGSD-FSEYV
gi|1362625|   RSEPHSYFQAVFP--KPPQNLTLQTVHTNLVVLHWQAP--EGSD-FSEYV
```

TABLE 2I-continued

ClustalW Analysis of NOV2

```
                960        970        980        990       1000
                ....|....|....|....|....|....|....|....|....|....|
NOV2A           RSNIISFQTPEG-PSDPEKDVYYANLSSSIILFWTPPS--KPNGIIQYY
gi|12621078|    RSSILNFRTPEGEPSDPPNDVHYVNLSSSILFWTPPV--KPNGIIQYY
gi|125977|      RSHPIILRTQEDVEGD-PQDVKATPLNSTSIHVSWKPPLEKDRNGIIRGY
gi|10728878|    RSHPIILRTQEDVEGD-PQDVKATPLNSTSIHVSWKPPLEKDRNGIIRGY
gi|7290546|     HPLELNVTMEPQ----PVSNVVPLVDSRNLTLEWP----RPDCHVDFY
gi|1362625|     HPLELNVTMEPQ----PVSNVVPLVDSRNLTLEWP----RPDGHVDFY 1010       1020       1030       1040       1050
                ....|....|....|....|....|....|....|....|....|....|
NOV2A           SVYYRNTSGTFMQNFTLHEVTNDFDNMTVSTIIDKLTIFSYYTFWLTAST
gi|12621078|    SVYYQNTSGTFVQNFTLLQVTKESDNVTVSARIYRLAIFSYYTFWLTAST
gi|125977|      ------------------------------------------------
gi|10728878|    ------------------------------------------------
gi|7290546|     ------------------------------------------------
gi|1362625|     ------------------------------------------------

1060       1070       1080       1090       1100
                ....|....|....|....|....|....|....|....|....|....|
NOV2A           SVGNGNKSSDIIEVYTDQDVPEGFVGNLTYESISSTAINVSWVPPAQPNG
gi|12621078|    SVGNGNKSSDIIHVYTDQDIPEGFVGNLTFESISSTAINVSWVPPAQPNG
gi|125977|      ---------------------------------------HIHAQELRDEG
gi|10728878|    ---------------------------------------HIHAQELRDEG
gi|7290546|     -----T---------------------------------LKWWPTDEEDR
gi|1362625|     -----T---------------------------------LKWWPTDEEDR 1110       1120       1130       1140       1150
                ....|....|....|....|....|....|....|....|....|....|
NOV2A           LVEYYVSLILQQIP-RHVRPPLVTYERSTYFDNLEKYIDYILKITPSTEK
gi|12621078|    LVFYYLSLNLQQSPPRHMIPPLVTYENSLDFDDLEKYIDYIFKITPSTEK
gi|125977|      KGELNEPFKFDVVD-----------TLEFNVTGLQPDIKYSIQVAALTRK
gi|10728878|    KGELNEPFKFDVVD-----------TLEFNVTGLQPDIKYSIQVAALTRK
gi|7290546|     VEFKNVTQLEDLSS-------P---SVRIPIEDLSPGRQYRFEVQASSN-
gi|1362625|     VEFKNVTQLEDLSS-------P---SVRIPIEDLSPGRQYRFEVQASSN- 1160       1170       1180       1190       1200
                ....|....|....|....|....|....|....|....|....|....|
NOV2A           GFSDTYTAQLYIKTEEDIPETSPIINTFKNLSSTSVLLSWDPPVKPNGAI
gi|12621078|    GFSETYTTQLHIKTEEDVPDTPPIINTFKNLSSTSILLSWDPPLKPNGAI
gi|125977|      GDGDRSAAIVVKTPGGVPVRPTVSDKIMEREPIVSIELEWERPAQTYGEL
gi|10728878|    GDGDRSAAIVVKTPGGVPVRPTVSDKIMEREPIVSIELEWERPAQTYGEL
gi|7290546|     G----------TRSG------------------I----------------
gi|1362625|     G----------TRSG------------------I----------------

1210       1220       1230       1240       1250
                ....|....|....|....|....|....|....|....|....|....|
NOV2A           ISYDLTL----QGPNENYSFITSDNYIILEELSPFTLYSFAAARTRKGL
gi|12621078|    LGYHLTL----QGPHANHTFVTSGNHIVLEELSPFTLYSFAAARTMKGL
gi|125977|      RGYRLRWGVKDQALKEEMLSGPQMTKKRFDNLERGVEYEFRVAGSNHIGI
gi|10728878|    RGYRLRWGVKDQALKEEMLSGPQMTKKRFDNLERGVEYEFRVAGSNHIGI
gi|7290546|     -------------------------THLSTRTMPLIQSDVFIANAGHEQGQ
gi|1362625|     -------------------------THLSTRTMPLIQSDVFIANAGHEQGQ 1260       1270       1280       1290       1300
                ....|....|....|....|....|....|....|....|....|....|
NOV2A           GPSSILFEYTDESVPLAPPQNLTLINCTSDFVWLKWSPSPLPGGIVKVYS
gi|12621078|    GPSSILFEYTDESAPLAPPQNLTINYTSDFVWLTWSPSPLPGGIVKVYS
gi|125977|      GQETVKIEQTPEGTPGGPPSNITIRFQTPDVLCVTWDPPTREHRNGIITR
gi|10728878|    GQETVKIEQTPEGTPGGPPSNITIRFQTPDVLCVTWDPPTREHRNGIITR
gi|7290546|     ----------------------------DETITLSYTPIPADSTRFDIYR
gi|1362625|     ----------------------------DETITLSYTPIPADSTRFDIYR 1310       1320       1330       1340       1350
                ....|....|....|....|....|....|....|....|....|....|
NOV2A           EKIHEHETDTIYYKNISGFKTEAKLVGLEPVSTYSIRVSAFTKVGNGNQF
gi|12621078|    EKIHEHETDTVFYKNISGLQTDAKLEGLEPVSTYSVSVSAFTKVGNGNQY
gi|125977|      YDVQFH------------------------------------------
gi|10728878|    YDVQFH------------------------------------------
gi|7290546|     ESMGD-------------------------------------------
gi|1362625|     ESMGD-------------------------------------------

1360       1370       1380       1390       1400
                ....|....|....|....|....|....|....|....|....|....|
NOV2A           SNVVKFTTQESVPDVVQNMQCMATSWQSVLVKWDPPKKANGIITQYMVIV
gi|12621078|    SNVVEFTTQESVPEAVRNIECVARDWQSVSVRWDPPRKTNGIIIHYMITV
gi|125977|      ------------------------------------------KK----ID
gi|10728878|    ------------------------------------------KK----ID
gi|7290546|     -----------------------------------------P--------TI
gi|1362625|     -----------------------------------------P--------TI
```

TABLE 2I-continued

ClustalW Analysis of NOV2

```
                    1410       1420       1430       1440       1450
                ....|....|....|....|....|....|....|....|....|....|
NOV2A           ERNSTKVSPQDHMYPFIKLLANISYVFKVRASTSAGEGDESTCHVSTLPE
gi|12621078|    GGNSTKVSPRDPTYTFIKLLPNISYVFEVRASTSAGEGNESRCDISTLPE
gi|125977|      HGLGSERNMTLRKAVFINLEENTEYIFRVRAYTKQGAGPFSDKLIVETER
gi|10728878|    HGLGSERNMTLRKAVFINLEENTEYIFRVRAYTKQGAGPFSDKLIVETER
gi|7290546|     KDKEKLANDTERKLSFSGLTPGKLYNVTVWTVS----GGVASLPVQRLYR
gi|1362625|     KDKEKLANDTERKLSFSGLTPGKLYNVTVWTVS----GGVASLPVQRVYR 1460       1470       1480       1490       1500
                ....|....|....|....|....|....|....|....|....|....|
NOV2A           TVPSVPTNIAFSDVQSTSATLTWIRPDIILGYFQNYKITTQLRAQKCKEW
gi|12621078|    TVPSVPTNVAFSNVQSTSATLTWIRPDIILGYFQNYKITTQLRAQKCKEW
gi|125977|      DMGRAPMSLQAEATSEQTAEIWWEPVTSRGKLLGYKIFYIMTAVE-----
gi|10728878|    DMGRAPMSLQAEATSEQTAEIWWEPVTSRGKLLGYKIFYIMTAVE-----
gi|7290546|     LHPLPISDLKAIQVAAREITLHWTAPAGEYTDFELQYLSADEEAP-----
gi|1362625|     LHPLPISDLKAIQVAAREITLHWTAPAGEYTDFELQYLSADEEAP-----

1510       1520       1530       1540       1550
                ....|....|....|....|....|....|....|....|....|....|
NOV2A           ESEECVEYQKIQYLYEAHLTEETVYGLKKFRWYRFQVAASINACYGNASN
gi|12621078|    ESEECIEHQKDQYLYEANQTEETVHGLKFRWYRFQVAASINVGYSNASE
gi|125977|      ------DLDDWQTKTVGLTESADLVNLEKFAQYAVAIAARFKNGLGRLSE
gi|10728878|    ------DLDDWQTKTVGLTESADLVNLEKFAQYAVAIAARFKNGLGRLSE
gi|7290546|     ------QLLQN--VTKN--TEITLQGLRPYHNYTFTVVVRSGS-IQG---
gi|1362625|     ------QLLQN--VTKN--TEITLQGLRPYHNYTFTVVVRSGS-IQG---

1560       1570       1580       1590       1600
                ....|....|....|....|....|....|....|....|....|....|
NOV2A           WISTKTLPGPPDGPPENVHVVATSPFSISISWSEPAVITGPTCVLIDVKS
gi|12621078|    WISTQTLPGPPDGPPENVHVVATSPFGINISWSEPAVITGPTFYLIDVKS
gi|125977|      KVTVRIK---PEDVPLNERAHDVSTHSMTLSWSPPIRLT-PVNYKLSFDA
gi|10728878|    KVTVRIK---PEDVPLNERAHDVSTHSMTLSWSPPIRLT-PVNYKISFDA
gi|7290546|     ----------TDFADVSVSTLMRSSAPTSASYQTLTAPPGKVPYFQPSD-
gi|1362625|     ----------TDFADVSVSTLMRSSAPTSASYQTLTAPPGKVPYFQPSD- 1610       1620       1630       1640       1650
                ....|....|....|....|....|....|....|....|....|....|
NOV2A           VDNDEFNISFIKSNEENKTIEIKDLEIFTRYSVVITAFTGNISAAYVEGK
gi|12621078|    VDDDDFNISFLKSNEENKTTEINNLEVFTRYSVVITAFVGNVSRAYTDGK
gi|125977|      MK------------------------------------------------
gi|10728878|    MK------------------------------------------------
gi|7290546|     VQ------------------------------------------------
gi|1362625|     VQ------------------------------------------------

1660       1670       1680       1690       1700
                ....|....|....|....|....|....|....|....|....|....|
NOV2A           SSAEMIVTTLESAPKDEENNMTFQKUPDEVTKFQLTFLPPSQPNGNTQVY
gi|12621078|    SSAEMIITTLESVPKDEENNMTFQKUPDEVTKFQLTFLPPSQPNGNIRVY
gi|125977|      ----------------VFVDSQGFSQT----------QIVPKREITLKH
gi|10728878|    ----------------QVFDSQGFSQT----------QIVPKREITLKH
gi|7290546|     ----------------EGEVTFEWS----------LEPAEQHGPIDYF
gi|1362625|     ----------------EGEVTFEWS----------LEPAEQHGPIDYF 1710       1720       1730       1740       1750
                ....|....|....|....|....|....|....|....|....|....|
NOV2A           QALVYREDDPTAVQIHNLSIIQKTNTFVIAMLEGLKGGHTYNISVYAVNS
gi|12621078|    QALVYREDDPTAVQIHNFSIIQKTDTSIIAMLSGLKGGHTYNISVYAINS
gi|125977|      YVKTHTINELSPFFTTYNVNVSAIPS-----DYSYRPPTKITVTTQMAAPQ
gi|10728878|    YVKTHTINELSPFFTTYNVNVSAIPS-----DYSYRPPTKITVTTQMAAPQ
gi|7290546|     RITCQNADDAADVSSYEFPVNATQG-----KIDGLVPGNHYIFRIQAKSA
gi|1362625|     RITCQNADDAADVSSYEFPVNATQG-----KIDGLVPGNHYIFRIQAKSA 1760       1770       1780       1790       1800
                ....|....|....|....|....|....|....|....|....|....|
NOV2A           AGAGPKVPMRITMEIKAEARPKTKPTPIYDATGKLLVTSTTITIRMPICY
gi|12621078|    AGAGPKVQMRITMEIKAEARPKSKPIPIRDATGKLLVTSTTITIRMPICY
gi|125977|      PMVKPDFYGVVNGEEILVIPQASEEYGPISH------YYLVVVPEDKSN
gi|10728878|    PMVKPDFYGVVNGEEILVIPQASEEYGPISH------YYLVVVPEDKSN
gi|7290546|     LGYCAEREHIQTMPIIAEPVPEPSVTPLEVSR-----TSSTIELSFRQCY
gi|1362625|     LGYCAEREHIQTMPIIAEPVPEPSVTPLEVSR-----TSSTIELSFRQCY 1810       1820       1830       1840       1850
                ....|....|....|....|....|....|....|....|....|....|
NOV2A           YSDDHGPIKNVQVLVIETGAQHDG--NVTKWYDAYFNKAR-PYFTNEGFP
gi|12621078|    YNDDHGPIRNVQVLVAETGAQQDG--NVTKWYDAYFNKAR-PYFTNEGFP
gi|125977|      LHKIPDQFLTDDLLPGRNKPERPN----APYIAAKFPQRSIPFTFHLGSG
gi|10728878|    LHKIPDQFLTDDLLPGRNKPERPN----APYIAAKFPQRSIPFTFHLGSG
gi|7290546|     FSNAHGMVRSYTIIIAEDVGKNASGLEMPSWQDVQAYTWLPYQAIEPYN
gi|1362625|     FSNAHGMVRSYTIIIAEDVGKIASGLEMPSWQDVQAYTWLPYQAIEPYN
```

TABLE 2I-continued

ClustalW Analysis of NOV2

```
                      1860       1870       1880       1890       1900
                 ....|....|....|....|....|....|....|....|....|....|
NOV2A            NPPCTEGKTKFSGNEEIYIIGADNACMIPGNEDKICNGPLKPKKQYLFKF
gi|12621078|     NPPCIEGKTKFSGNEEIYVIGADNACMIPGNEEKICNGPLKPKKQYLFKF
gi|125977|       DDYHNFTNRKLEREKRYRIFVRAVVDTPQKP--LYTSSPFSEFLSLDMRE
gi|10728878|     DDYHNFTNRKLEREKRYRIFVRAVVDTPQKP--LYTSSPFSEFLSLDMRE
gi|7290546|      PFLTSNGSRKSSLEAEHFTIGTANCDKHQAG---YCNGPLRAGTTYRIKI
gi|1362625|      PFLTSNGSRKSSLEAEHFTIGTANCDKHQAG---YCNGPLRAGTTYRIKI 1910       1920       1930       1940       1950
                 ....|....|....|....|....|....|....|....|....|....|
NOV2A            RATNIMGQFTDSDYSDPVKTLGEGLSFRIVEIILSVTLCILSIILGTAI
gi|12621078|     RATNVMGCFTDSEYSDPIKTLGEGLSFRIVEIILSVTLCILSIILGTAI
gi|125977|       APPGERPHRPDPNWPAEPFVSVNRNKDEPEILWVLPLMVSIFIYSTALI
gi|10728878|     APPGERPHRPDPNWPAEPFVSVNRNKDEPEILWVLPLMVSIFIYSTALI
gi|7290546|      RAFTDEDKFTDIVYSSPITTE-----R-SDTVTVAATVSAVLLVAMVLVV
gi|1362625|      RAFTDEDKFTDIVYSSPITTE-----R-SDTVTVAATVSAVLLVAMVLVV 1960       1970       1980       1990       2000
                 ....|....|....|....|....|....|....|....|....|....|
NOV2A            FAFARIRQKQ-----KEGGTYSPQDAEIIDTKLKLDQLITVADLELKDER
gi|12621078|     FAFVRIRQKQ-----KEGGTYSPRDAEIIDTKFKLDQLITVADLELKDER
gi|125977|       VLCVVKRRQPCKTPDQAAVTRPLMAADLGAGPTPSDPVDMRRLNFQTPG
gi|10728878|     VLCVVKRRQPCKTPDQAAVTRPLMAADLGAGPTPSDPVDMRRLNFQTPG
gi|7290546|      VYCQHRCQLI-----RRASKLAR----------MQDELAALPEGYITPN-
gi|1362625|      VYCQHRCQLI-----RRASKLAR----------MQDELAALPEGYITPN- 2010       2020       2030       2040       2050
                 ....|....|....|....|....|....|....|....|....|....|
NOV2A            LT----------RPISKKSELQHVEELCTNNNLKFQEEFSELPKFLQDLSS
gi|12621078|     LTRLLSYRKSIKPISKKSELQHVEELCTNSNLKFQEEFSELPKFLQDLSS
gi|125977|       MIS-------HPPIPISEFANHIERLKSNDNQKFSQEYESIEPG-QQFTW
gi|10728878|     MIS-------HPPIPISEFANHIERLKSNDNQKFSQEYESIEPG-QQFTW
gi|7290546|      ----------RPVHVKDFSEHYTIMSADSDFRFSEEFEELKHVGRDQAC
gi|1362625|      ----------RPVHVKDFSEHYTIMSADSDFRFSEEFEELKHVGRDQAC 2060       2070       2080       2090       2100
                 ....|....|....|....|....|....|....|....|....|....|
NOV2A            TDADLPWNRAKNREPNIKPYNNNRVKLIADASVPGSDYINASYISGYLCP
gi|12621078|     TDADLPWNRAKNREPNIKPYNNNRVKLIADASLPGSDYINANYISGYLCP
gi|125977|       DNSNLEHNKSKNRYANVTAYDHSRVQLPAVEGVVGSDYINANYCDGYRKH
gi|10728878|     DNSNLEHNKSKNRYANVTAYDHSRVQLPAVEGVVGSDYINANYCDGYRKH
gi|7290546|      SFANLPCNRPKNRFTNILPYDHSRFKLQPVDDDGSDYINANYMPGHNSP
gi|1362625|      SFANLPCNRPKNRFTNILPYDHSRFKLQPVDDDGSDYINANYMPGHNSP 2110       2120       2130       2140       2150
                 ....|....|....|....|....|....|....|....|....|....|
NOV2A            NEFIATQGPLPGIVGDFWRMVWETRAKILVMLIQCFEKGRIRCHQYWEED
gi|12621078|     NEFIATQGPLPGIVGDFWRMVWETRTKILVMLIQCFEKGRIRCHQYWEED
gi|125977|       NAYVATQGPLQETFVDFWRMCWELKTATIVMMTRLEERTRIKCDQYWETR
gi|10728878|     NAYVATQGPLQETFVDFWRMCWELKTATIVMMTRLEERTRIKCDQYWETR
gi|7290546|      REFIVTQGPLHSTREEFWRMCWESNSRAIVMLTRCFEKGREKCDQYWEVD
gi|1362625|      REFIVTQGPFHSTREEFWRMCWESNSRAIVMLTRCFEKGREKCDQYWEVD 2160       2170       2180       2190       2200
                 ....|....|....|....|....|....|....|....|....|....|
NOV2A            NKPVTVFGDIVITKLMEDVQIDWIIRDLKIERH--GDCMTVRQCNFTAWP
gi|12621078|     NKPVTVFGDIVITKLMEDIQIDWIIRDLKIERH--GDCMTVRQCNFTGWP
gi|125977|       G--TETYGQIFVTITETQELATYSIRTFQLCRQGFNDRREIKQLQFTAWP
gi|10728878|     G--TETYGQIFVTITETQELATYSIRTFQLCRQGFNDRREIKQLQFTAWP
gi|7290546|      R-VAMFYGDIKVQLIIDTHYHDWSISEFMVSRN--CESRIMRHFHFTTWP
gi|1362625|      R-VAMFYGDIKVQLIIDTHYHDWSISEFMVSRN--CESRIMRHFHFTTWP 2210       2220       2230       2240       2250
                 ....|....|....|....|....|....|....|....|....|....|
NOV2A            EHGVPENSAPLIHFVKLVRASRAHDTTEMIVHCSAGVGRTGVFIALDHLT
gi|12621078|     EHGVPENTTPLIHFVKLVRTSRAHDTTEMVVHCSAGVGRTGVFIALDHLT
gi|125977|       DHGVPDHEAPFLQFLRRCALTPPESGEVIVHCSAGVGRTGCYIVIDSML
gi|10728878|     DHGVPDHEAPFLQFLRRCALTPPESGEVIVHCSAGVGRTGCYIVIDSML
gi|7290546|      DFGVPEPPQSLVRFVRAFRDVIGTDMRPIIVHCSAGVGRSGTFIALDRIL
gi|1362625|      DFGVPEPPQSLVRFVRAFRDVIGTDMRPIIVHCSAGVGRSGTFIALDRIL 2260       2270       2280       2290       2300
                 ....|....|....|....|....|....|....|....|....|....|
NOV2A            QHINDHDFVDIYGLVAELRSERMCMVQNLAQYIFIHQCILDLLS------
gi|12621078|     QHINNHDFVDIYGLVAELRSERMCMVQNLAQYIFIHQCILDLLS------
gi|125977|       ERMKHEKIIDIYGHVTCLRACRNYMVQTEDQYIFIHDAILEAIICG----
gi|10728878|     ERMKHEKIIDIYGHVTCLRACRNYMVQTEDQYIFIHDAILEAIICG----
gi|7290546|      QHIHKSDYVDIFGIVFAMRKERVMVQTEQQYVCIHQCLIAVLEGKEHLL
gi|1362625|      QHIHKSDYVDIFGIVFAMRKERVMVQTEQQYVCIHQCLIAVLEGKEHLL
```

TABLE 2I-continued

ClustalW Analysis of NOV2

```
                  2310      2320      2330      2340      2350
             ....|....|....|....|....|....|....|....|....|....|
NOV2A        --------NKGSNQPICFVNYSALQKMDSLDAMEGGDVELEWEEITM---
gi|12621078| --------NKGGHQPVCFVNYSTLQKMDSLDAMEG-DVELEWEEITM---
gi|125977|   --VTEVPARNLHTHLQKLITEEGETISGMEVEFKKLSNVKMDSSKFVTA
gi|10728878| --VTEVPARNLHTHLQKLITEEGETISGMEVEFKKLSNVKMDSSKFVTA
gi|7290546|  ADSLELHANDGYEVTKIYLERQEQTKMGTLPIRASLAMAEKLDADLMTNK
gi|1362625|  ADSLELHANDGYEVTKIYLERQEQTKMGTLPIRASLAMAEKLDADLMTNK 2360      2370      2380      2390      2400
             ....|....|....|....|....|....|....|....|....|....|
NOV2A        --------------------------------------------------
gi|12621078| --------------------------------------------------
gi|125977|   NLPCNKHKNRLVHILPYESSRVYLTPIHGIEGSDYVNASFIDGYRYRSAY
gi|10728878| NLPCNKHKNRLVHILPYESSRVYLTPIHGIEGSDYVNASFIDGYRYRSAY
gi|7290546|  DEDEDQEQQQQQQLQ-----------------------LATEVKPKGSN
gi|1362625|  DEDEDQEQQQQQQLQ-----------------------LATEVKPKGSN 2410      2420      2430      2440      2450
             ....|....|....|....|....|....|....|....|....|....|
NOV2A        --------------------------------------------------
gi|12621078| --------------------------------------------------
gi|125977|   IAAQGPVQDAAEDFWRMLWEHNSTIVVMLTKLKEMGREKCFQYWPHERSV
gi|10728878| IAAQGPVQDAAEDFWRMLWEHNSTIVVMLTKLKEMGREKCFQYWPHERSV
gi|7290546|  DDEEDEEDDDDDDDQQPLNNETTATLSSASCSSS---------THDVHV
gi|1362625|  DDEEDEEDDDDDDDQQPLNNETTATLSSASCSSS---------THDVHV 2460      2470      2480      2490      2500
             ....|....|....|....|....|....|....|....|....|....|
NOV2A        --------------------------------------------------
gi|12621078| --------------------------------------------------
gi|125977|   RYQYYVVDPIAEYNMPQYKLREFKVTDARDGSSRTVRQFQFIDWPEQGVP
gi|10728878| RYQYYVVDPIAEYNMPQYKLREFKVTDARDGSSRTVRQFQFIDWPEQGVP
gi|7290546|  VLQEAIEKPKQEQERICAGTQSHADTESDNTDSDDDDEDGDGKVAKDCAV
gi|1362625|  VLQEAIEKPKQEQERICAGTQSHADTESDNTDSDDDDEDGDGKVAKDCAV 2510      2520      2530      2540      2550
             ....|....|....|....|....|....|....|....|....|....|
NOV2A        --------------------------------------------------
gi|12621078| --------------------------------------------------
gi|125977|   KSGEGFIDFIGQVHKTKEQFGQDGPITVHCSAGVGRSGVFITLSIVLERM
gi|10728878| KSGEGFIDFIGQVHKTKEQFGQDGPITVHCSAGVGRSGVFITLSIVLERM
gi|7290546|  ADEDCWWY----------------------------------------
gi|1362625|  ADEDCWWY----------------------------------------

2560      2570      2580      2590
             ....|....|....|....|....|....|....|....|....|...
NOV2A        -------------------------------------------------
gi|12621078| -------------------------------------------------
gi|125977|   QYEGVLDVFQTVRILRSQRPAMVQTEDQYHFVTRAALEYLGSFDNYTN
gi|10728878| QYEGVLDVFQTVRILRSQRPAMVQTEDQYHFVTRAALEYLGSFDNYTN
gi|7290546|  -------------------------------------------------
gi|1362625|  -------------------------------------------------
```

Tables 2J–2EE list the domain descriptions from DOMAIN analysis results against NOV2a. This indicates that the NOV2a sequence has properties similar to those of other proteins known to contain this domain.

TABLE 2J

Domain Analysis of NOV2a gnl|Smart|smart00194, PTPc, Protein tyrosine phosphatase, catalytic domain (SEQ ID NO:93)
CD-Length = 264 residues, 99.6% aligned
Score = 318 bits (816), Expect = 2e-87

```
NOV 1:  1983  KFQEEFSELPK-FLQDLSSTDADLPWNRAKNRFPNIKPYNNNRVKIIADASVPGSDYINA  2041
              +|||  +| +    |||  |  || ||  |||+ ++ ||++ ||||         |||||||
Sbjct:     1  GLEEEFEKLQRLTPDDLSCTVAILPENRDKNRYKDVLPYDHTRVKL-KPPPGEGSDYINA   59

NOV 1:  2042  SYISGYLCPNEFIATQGPLPGTVGDFWRMVWETRAKTLVMLTQCFEKORIRCHQYWPEDN  2101
              ||| |   | +|||||||||  ||  ||||||||||| +   +||||+    |||| +| |||||
Sbjct:    60  SYIDGPNRPKAYIATQGPLPSTVEDPWRMVWEEKVPVIVMLTELVEKGREKCAQYWPEKE   119
```

TABLE 2J-continued

Domain Analysis of NOV2a

```
NOV 1:  2102  KPVTVFGDIVITKLMEOVQIDWTIRDLKIERHG--DCMTVRQCNFTAWPEHGVPENSAPL  2159
              +|||+|    +   |+|||  |++  |  +  ||   ++| |+|||||+   |
Sbjct:   120  GGSLTYGDITVTLKSVEKVDDYTIRTLEVTNTGGSETRTVTHYHYTNWPDHGVPESPKSL  179

NOV 1:  2160  IHFVKLVRASRAH--DTTPMIVHCSAGVGRTGVFIALDHLTQHINDHDFVDIYGLVAELR  2217
              +  |+  ||  |++  ++ |++||||||||||||  |||+|  |  +   |||+ +|||
Sbjct:   180  LDLVRAVRKSQSTLRNSGPIVVHCSAGVGRTGTFIAIDILLQQLEAGKEVDIFEIVKELR  239

NOV 1:  2218  SERMCMVQNLAQYIFLHQCILDLL  2241
              |+|  |||  |||||||++ ||+ |
Sbjct:   240  SQRPGMVQTEEQYIFLYRAILEYL  263
```

TABLE 2K

Domain Analysis of NOV2a gnl|Pfam|pfam00102, Y_phosphatase, Protein-tyrosine phosphatase (SEQ ID NO:94)
CD-Length = 235 residues, 100.0% aligned
Score = 275 bits (704), Expect = 2e-74

```
NOV 1:  2008  NRAKNRFPNIKPYNNNRVKLIADASVPGSDYINASYISGYLCPNEFIATQGPLPGTVGDF  2067
              |+ |||+ ++ ||++ ||||             |||||||||+  ||   +|||||||| |+ ||
Sbjct:     1  NKEKNRYKDVLPYDHTRVKL-KPLGDEDSDYINASYVDGYKKPKAYIATQGGPLPNTIEDF  59

NOV 1:  2068  WRMVWETRAKTLVMLTQCFEKGRIRCHQYWPEDNKPVTVFGDI-VITKLMEDVQIDWTIR  2126
              ||||||  + + +||||+   |||| +| |||||   +|     +|   |+  + |+|+|
Sbjct:    60  WRMVWEEKVRVIVMLTELVEKGREKCAQYWPEKEGGSLTYGDFTVTCVSVEKKKDDYTVR  119

NOV 1:  2127  DLKIERHGDC--MTVRQCNFTAWPEHGVPENSAPLIHFVKLVRASRAH-DTTPMIVHCSA  2183
              |++   ||    ||+ ++| ||+|||||+   ++ ||  +  |+ |+      |++|||||
Sbjct:   120  TLELTNSGDDETRTVKHYHYTGWPDHGVPESPKSILDLLRKVRKSGTPDDGPIVVHCSA  179

NOV 1:  2184  GVGRTGVFIALDHLTQHINDHDFVDIYGLVAELRSERMCMVQNLAQYIFLHQCILD  2239
              |+|||  |||+|  |  +     ||++  +|||+|  |||  ||||++ ||+
Sbjct:   180  GIGRTGTFIAIDILLQQLEKEGVVDVFDTVKKLRSQRPGMVQTEEQYIFIYDAILE  235
```

TABLE 2L

Domain Analysis of NOV2a gnl|Smart|smart00404, PTPc_motif, Protein tyrosine phosphatase,
catalytic domain motif (SEQ ID NO:95)
CD-Length = 105 residues, 100.0% aligned
Score = 120 bits (301), Expect = 8e-28

```
NOV 1:  2138  TVRQCNFTAWPEHGVPENSAPLIHFVKLVRASRAH--DTTPMIVHCSAGVGRTGVFIALD  2195
              ||+ ++|  ||+|||||+  ++ |++ |+ |  |     +  |++|||||||||||||  |+|+|
Sbjct:     1  TVKHYHYTGWPDHGVPESPDSILEFLRAVKKSLNKSANNGPVVVHCSAGVGRTGTFVAID  60

NOV 1:  2196  HLTQHI-NDHDFVDIYGLVAELRSERMCMVQNLAQYIFLHQCILD  2239
              |  | +    |||+ +| ||||+|    ||  | ||+||++  +|+
Sbjct:    61  ILLQQLEAGTGEVDIFDIVKELRSQRPGAVQTLEQYLFLYRALLE  105
```

TABLE 2M

Domain Analysis of NOV2a gnl|Pfam|pfam00041, fn3, Fibronectin type III domain (SEQ ID NO:96)
CD-Length = 86 residues, 100.0% aligned
Score = 60.8 bits (146), Expect = 8e-10

```
NOV 1:    54  PGPPVFLAGERVGSAGILLSWNTPPNPNGRIISYIVKYKEVCPWMQTVYTQVRSKPDSLE  113
              |   |     |   | + |||+ |||+ ||  |   |+|  |     + ++   +
Sbjct:     1  PSAPTNLTVTDVTSTSLTLSWSPPPDGNPITGYEVEYQPVNS--GEEWNEITVPGTTTS   58

NOV 1:   114  VLLTNLNPGTTYEIKVAAENSAGIGVFS  141
              || | ||| ||++|  | |   |  |
Sbjct:    59  YTLTGLKPGTEYEVRVQAVNGGGNGPPS  86
```

TABLE 2N

Domain Analysis of NOV2a gnl|Pfam|pfam00041, fn3, Fibronectin type III domain (SEQ ID NO:96)
CD-Length = 86 residues, 95.3% aligned
Score = 58.9 bits (141), Expect = 3e-09

```
NOV 1:    659  SSPQDVEVIDVTADEIRLKWSPPEKPNGIIAYEVLYKNIDTLYMKNT-----STTDIIL  713
               |+| ++  | |||+ +  ||||  ||   |||  |+ +++     |     +|| |
Sbjct:      2  SAPTNLTVTDVTSTSLTLSWSPPPDGNGPITGYEVEYQPVNSGEEWNEITVPGTTTSYTL  61

NOV 1:    714  RNLRPHTLYNISVRSYTRFGHG  735
               |+| | |  + |++     |+|
Sbjct:     62  TGLKPGTEYEVRVQAVNGGGNG  83
```

TABLE 2O

Domain Analysis of NOV2a gnl|Pfam|pfam00041, fn3, Fibronectin type III domain (SEQ ID NO:96)
CD-Length = 86 residues, 100.0% aligned
Score = 57.0 bits (136), Expect = 1e-08

```
NOV 1:   1330  PDVVQNMQCMATSWQSVLVKWDPPKKANGIITQYMVTV-------ERNSTKVSPQDHMYT  1382
                |    |+    + |++ ||   |||| |              |  |   |      ||
Sbjct:      1  PSAPTNLTVTDVTSTSLTLSWSPPPDGNGPITGYEVEYQPVNSGEEWNEITVPGTTTSYT  60

NOV 1:   1383  FIKLLANTSYVFKVRASTSAGEGDES  1408
                |    |   +|+|    |||   |
Sbjct:     61  LTGLKPGTEYEVRVQAVNGGGNGPPS  86
```

TABLE 2P

Domain Analysis of NOV2a gnl|Pfam|pfam00041, fn3, Fibronectin type III domain (SEQ ID NO:96)
CD-Length = 86 residues, 98.8% aligned
Score = 53.1 bits (126), Expect = 2e-07

```
NOV 1:    753  SAPENITYKNISSGEIELSFLPPSSPNGIIQKYTIYLKRSNGNE---ERTINTTSLTQNI  809
               |||  |+   +++|  + ||+ ||  | |    |  + |   |+  |+ + +
Sbjct:      2  SAPTNLTVTDVTSTSLTLSWSPPPDGNGPITGYEVEYQPVNSGEEWNEITVPGTTTSYTL  61

NOV 1:    810  KGLKKYTQYIIEVSASTLKGEGVRS  834
               |||  |+| +  | |     |||  |
Sbjct:     62  TGLKPGTEYEVRVQAVNGGGNGPPS  86
```

TABLE 2Q

Domain Analysis of NOV2a gnl|Pfam|pfam00041, fn3, Fibronectin type III domain (SEQ ID NO:96)
CD-Length = 86 residues, 95.3% aligned
Score = 52.4 bits (124), Expect = 3e-07

```
NOV 1:    848  SPPQDFSVKQLSGVTVKLSWQPPLEPNGIILYYTVYVWR----SSLKTINV--TETSLEL  901
               |  | + +|  ++ ++ ||| || + |||  || |           | ||   | ||
Sbjct:      2  SAPTNLTVTDVTSTSLTLSWSPPPDGNGPITGYEVEYQPVNSGEEWNEITVPGTTTSYTL  61

NOV 1:    902  SDLDYNVEYSAYVTASTRFGDG  923
               + |   ||  | |    |+|
Sbjct:     62  TGLKPGTEYEVRVQAVNGGGNG  83
```

TABLE 2R

Domain Analysis of NOV2a gnl|Pfam|pfam00041, fn3, Fibronectin type III domain (SEQ ID NO:96)
CD-Length = 86 residues, 91.9% aligned
Score = 51.6 bits (122), Expect = 5e-07

TABLE 2R-continued

Domain Analysis of NOV2a

```
NOV 1:   1148 TFKNLSSTSVLLSWDPPVKPNGAIISYDLTLQGPNENYSFIT-----SDNYIILEELSPF 1202
              | +++|||+ ||| ||   || |  |++ | |    +        +    | | |
Sbjct:      8 TVTDVTSTSLTLSWSPPPDGNGPITGYEVEYQPVNSGEEWNEITVPGTTTSYTLTGLKPG 67

NOV 1:   1203 TLYSFFAAARTRKGLGPSS 1221
              | |         | ||| |
Sbjct:     68 TEYEVRVQAVNGGGNGPPS 86
```

TABLE 2S

Domain Analysis of NOV2a gnl|Pfam|pfam00041, fn3, Fibronectin type III domain (SEQ ID NO:96)
CD-Length = 86 residues, 94.2% aligned
Score = 51.2 bits (121), Expect = 6e-07

```
NOV 1:   1235 PPQNLTLINCTSDFVWLKWSPSPLPGGIVKVYSFK-IHEHETDTIYYKNISGFKTEAKLV 1293
              | |||+ + ||  + | |||     |   + |  +   + +        +  |    |
Sbjct:      3 APTNLTVTDVTSTSLTLSWSPPPDGNGPITGYEVEYQPVNSGEEWNEITVPGTTTSYTLT 62

NOV 1:   1294 GLEPVSTYSIRVSAFTKVGNG 1314
              ||+| + | +||    |||
Sbjct:     63 GLKPGTEYEVRVQAVNGGGNG 83
```

TABLE 2T

Domain Analysis of NOV2a gnl|Pfam|pfam00041, fn3, Fibronectin type III domain (SEQ ID NO:96)
CD-Length = 86 residues, 100.0% aligned
Score = 49.7 bits (117), Expect = 2e-06

```
NOV 1:   1420 PSVPTNIAFSDVQSTSATLTWIRPDTILGYFQNYKITTQLRAQKCKEWESEECVEYQKIQ 1479
              ||  |||+  +||  ||| ||+|     |    |       |++ |         || |
Sbjct:      1 PSAPTNLTVTDVTSTSLTLSWSPPPDGNGPITGYEVEYQ------PVNSGEEWNEITV-- 52

NOV 1:   1480 YLYEAHLTEETVYGLKKFRWYRFQVAASTNAGYGNAS 1516
                 |+ |||    |  +|     |||
Sbjct:     53 ---PGTTTSYTLTGLKPGTEYEVRVQAVNGGGNGPPS 86
```

TABLE 2U

Domain Analysis of NOV2a gnl|Pfam|pfam00041, fn3, Fibronectin type III domain (SEQ ID NO:96)
Cd-Length = 86 residues, 98.8% aligned
Score = 47.4 bits (111), Expect = 9e-06

```
NOV 1:    940 DPPKDVYYANLSSSSIILFWTPPSKPNGIIQYYSVYYRNT-SGTFMQNFTLHEVTNDFDN 998
              |  ++   +++|+|+ | |+||   ||  |  |    |+   |  |+    |+   |
Sbjct:      2 SAPTNLTVTDVTSTSLTLSWSPPPDGNGPITGYEVEYQPVNSGEEWNEITVPGTTT---- 57

NOV 1:    999 MTVSTIIDKLTIFSYYTFWLTASTSVGNGNKS 1030
              |   +    +   + |   ||| |
Sbjct:     58 ---SYTLTGLKPGTEYEVRVQAVNGGGNGPPS 86
```

TABLE 2V

Domain Analysis of NOV2a gnl|Pfam|pfam00041, fn3, Fibronectin type III domain (SEQ ID NO:96)
CD-Length = 86 residues, 91.9% aligned
Score = 47.0 bits (110), Expect = 1e-05

```
NOV 1:   1530 GPPENVHVVATSPFSISISWSEPAVITGP-TCYLIDVKSVDNEFNISFIKSNEENKTIE 1588
              | |+ |   +  |+++|||  |   ||    || |  ++ + |++   +              +
Sbjct:      2 SAPTNLTVTDVTSTSLTLSWSPPPDGNGPITGYEVEYQPVNSGEEWNEITVPGTTT-SYT 60
```

TABLE 2V-continued

Domain Analysis of NOV2a

```
NOV 1:   1589  IKDLEIFTRYSVVITAFTGN  1608
                +  |+  |  |  |  +  |  |
Sbjct:     61  LTGLKPGTEYEVRVQAVNGG  80
```

TABLE 2W

Domain Analysis of NOV2a gnl|Pfam|pfam00041, fn3, Fibronectin type III domain (SEQ ID NO:96)
CD-Length = 86 residues, 96.5% aligned
Score = 46.6 bits (109), Expect = 2e-05

```
NOV 1:   1633  DPPNNMTFQKIPDEVTKFQLTFLPPSQPNGNIQVYQALVYREDDPTAVQIHNLSIIQKTN  1692
                |  |+|    +      |    |++ ||     ||      |+       +         +        +
Sbjct:      2  SAPTNLTVTDVTS--TSLTLSWSPPPDGNGPITGYEVEYQPVNSGEEWNEITVPGTTTS-  58

NOV 1:   1693  TFVIAMLEGLKGGHTYNISVYAVNSAGAGP  1722
                |  |||    |  +  |   |||   |  ||
Sbjct:     59  ----YTLTGLKPGTEYEVRVQAVNGGGNGP  84
```

TABLE 2X

Domain Analysis of NOV2a gnl|Pfam|pfam00041, fn3, Fibronectin type III domain (SEQ ID NO:96)
CD-Length = 86 residues, 98.8% aligned
Score = 44.7 bits (104), Expect = 6e-05

```
NOV 1:    303  GPPQNCVTGNITGKSFSILWDPPTIVTGKFS-YRVELY---GPSAGRILDNSTKDLKFAF  358
                |  |    ++|   |  ++ |  ||     |  +  |  ||         +           +
Sbjct:      2  SAPTNLTVTDVTSTSLTLSWSPPPDGNGPITGYEVEYQPVNSGEEWNEITVPGTTTSYTL  61

NOV 1:    359  TNLTPFTMYDVYIAAETSAGTGPKS  383
                |  |  |  |  |+|   +  |        |  ||  |
Sbjct:     62  TGLKPGTEYEVRVQAVNGGGNGPPS  86
```

TABLE 2Y

Domain Analysis of NOV2a gnl|Pfam|pFam00041, fn3, Fibronectin type III domain (SEQ ID NO:96)
CD-Length = 86 residues, 100.0% aligned
Score = 43.1 bits (100), Expect = 2e-04

```
NOV 1:    561  PLSAQNFRVTHVTITEVFLHWDPPDPVF--FHHYLITILDVENQSKSIILRTLNSLSLVL  618
                |  +   |    ||  ||||   |   +  |  |  ||              |  +       |  +  +   +      ++
Sbjct:      1  PSAPTNLTVTDVTSTSLTLSWSPPPDGNGPITGYEVEYQPVNSGEEWNEITVPGTTTSVT  60

NOV 1:    619  I-GLKKYTKYKMRVAASTHVGESSLS  643
                +  |||     |+|++||   |        |       |
Sbjct:     61  LTGLKPGTEYEVRVQAVNGGGNGPPS  86
```

TABLE 2Z

Domain Analysis of NOV2a gnl|Pfam|pfam00041, fn3, Fibronectin type III domain (SEQ ID NO:96)
CD-Length = 86 residues, 93.0% aligned
Score = 38.5 bits (88), Expect = 0.004

```
NOV 1:   1047  VGNLTYESISSTAINVSWVPPAQPNGLVFYY-VSLILQQTPRHVRPPLVT-YERSIYFDN  1104
                |||    ++||++  +||  ||     || +   |  |          +            |                |
Sbjct:      4  PTNLTVTDVTSTSLTLSWSPPPDGNGPITGYEVEYQPVNSGEEWNEITVPGTTTSYTLTG  63

NOV 1:   1105  LEKYTDYILKITPSTEKGFS  1124
                |+    |+|  +++              |
Sbjct:     64  LKPGTEYEVRVQAVNGGGNG  83
```

TABLE 2AA

Domain Analysis of NOV2a gnl|Smart|smart00060, FN3, Fibronectin type 3 domain; One of three
types of internal repeat within the plasma protein, fibronectin. The
tenth fibronectin type III repeat contains a RGD cell recognition
sequence in a flexible loop between 2 strands. Type III modules are
present in both extracellular and intracellular proteins. (SEQ ID NO:97)
CD-Length = 83 residues, 96.4% aligned
Score = 54.7 bits (130), Expect = 6e-08

```
NOV 1:    54 PGPPVFLAGERVGSAGILLSWNTPPNP-NGRIISYIVKYKEVCPWMQTVYTQVRSKPDSL  112
             | || |    | | + ||| ||+   | |+ | |+|+|   | +      +
Sbjct:     1 PSPPSNLRVTDVTSTSVTLSWEPPPDDITGYIVGYRVEYREEGEWKEVNVTP----SSTT   56

NOV 1:   113 EVLLTNLNPGTTYEIKVAAENSAG  136
             || | ||| || +| | |
Sbjct:    57 SYTLTGLKPGTEYEFRVRAVNGEA   80
```

TABLE 2BB

Domain Analysis of NOV2a gnl|Smart|smart00060, FN3, Fibronectin type 3 domain; One of three
types of internal repeat within the plasma protein, fibronectin. The
tenth fibronectin type III repeat contains a RGD cell recognition
sequence in a flexible loop between 2 strands. Type III modules are
present in both extracellular and intracellular proteins. (SEQ ID NO:97)
CD-Length = 83 residues, 92.8% aligned
Score = 52.8 bits (125), Expect = 2e-07

```
NOV 1:   659 SSPQDVEVIDVTADEIRLKWSPPEKP-NGIIIAYEVLYKNID---TLYMKNTSTTDIILR  714
             | | ++ | |||+  + | ||       |+ | | |+        + + +|||    |
Sbjct:     2 SPPSNLRVTDVTSTSVTLSWEPPPDDITGYIVGYRVEYREEGEWKEVNVTPSSTTSYTLT   61

NOV 1:   715 NLRPHTLYNISVRSYTR  731
             |+| | |  ||+
Sbjct:    62 GLKPGTEYEFRVRAVNG   78
```

TABLE 2CC

Domain Analysis of NOV2a gnl|Smart|smart00060, FN3, Fibronectin type 3 domain; One of three
types of internal repeat within the plasma protein, fibronectin. The
tenth fibronectin type III repeat contains a RGD cell recognition
sequence in a flexible loop between 2 strands. Type III modules are
present in both extracellular and intracellular proteins. (SEQ ID NO:97)
CD-Length = 83 residues, 94.0% aligned
Score = 45.4 bits (106), Expect = 3e-05

```
NOV 1:  1235 PPQNLTLINCTSDFVWLKWSPSPLPGGIVKVYSFKIHEHETDTIYYKNISGFKTEAKLVG  1294
             || || + + ||  | | | |        |   + | +        |  |  |    | |
Sbjct:     3 PPSNLRVTDVTSTSVTLSWEPPPDDITGYIVGYRVEYREEGEWKEVNVTPSSTTSYTLTG   62

NOV 1:  1295 LEPVSTYSIRVSAFTKVG  1312
             |+| + | ||| |
Sbjct:    63 LKPGTEYEFRVRAVNGEA    80
```

TABLE 2DD

Domain Analysis of NOV2a gnl|Smart|smart00060, FN3, Fibronectin type 3 domain; One of three
types of internal repeat within the plasma protein, fibronectin. The
tenth fibronectin type III repeat contains a RGD cell recognition
sequence in a flexible loop between 2 strands. Type III modules are
present in both extracellular and intracellular proteins. (SEQ ID NO:97)
CD-Length = 83 residues, 100.0% aligned
Score = 42.7 bits (99), Expect = 2e-04

TABLE 2DD-continued

Domain Analysis of NOV2a

```
NOV 1:   561 PLSAQNFRVTHVTITEVFLHWDPPDPVFFHHYLITILDVENQSKSIILRTLNS--LSLVL  618
                 | ||| || | | | |+||    + +  ++  + +   +    |   | |
Sbjct:     1 PSPPSNLRVTDVTSTSVTLSWEPPPDDITGYIVGYRVEYREEGEWKEVNVTPSSTTSYTL  60

NOV 1:   619 IGLKKYTKYKMRVAASTHVGESS 641
                 |||   |+|+ || |
Sbjct:    61 TGLKPGTEYEFRVRAVNGEAGEG 83
```

TABLE 2EE

Domain Analysis of NOV2a gnl|Smart|smart00060, FN3, Fibronectin type 3 domain; One of three
types of internal repeat within the plasma protein, fibronectin. The
tenth fibronectin type III repeat contains a RGD cell recognition
sequence in a flexible loop between 2 strands. Type III modules are
present in both extracellular and intracellular proteins. (SEQ ID NO: 97)
CD-Length = 83 residues, 92.8% aligned
Score = 41.2 bits (95), Expect = 7e-04

```
NOV 1:   848 SPPQDFSVKQLSGVTVKLSWQPPLEP-NGIILYYTVYVWRSS----LKTINVTETSLELS  902
             ||| +  |  ++ +| |||+|| +    | |+ | |          +    + || |+
Sbjct:     2 SPPSNLRVTDVTSTSVTLSWEPPPDDITGYIVGYRVEYREEGEWKEVNVTPSSTTSYTLT  61

NOV 1:   903 DLDYNVEYSAYVTASTR 919
                |   ||   | |
Sbjct:    62 GLKPGTEYEFRVRAVNG 78
```

Receptor tyrosine phosphatases (rPTPs) are part of the signaling cascades that control cell survival, proliferation and differentiation. The novel protein tyrosine phosphatase described in the application contains a phosphatase domain and thirteen fibronectin type III repeats. It closely resembles rPTP-GMC 1, a rat membrane phosphatase that is expressed in kidney glomerulus and is upregulated in response to kidney injury (Wright et. al. J Biol Chem 1998 Sep. 11;273 (37):23929–37). Tissue specificity of PTPs varies widely; for eg rPTP-GMC1 is expressed by mesangial cells in the kidney while GLEPP1 (another membrane phosphatase) is expressed by podocytes in the kidney (Thomas et. al.; J Biol Chem 1994 Aug. 5;269(31):19953–62). Tappia et. al. demonstrated expression of a PTP in the liver could regulate the activity of the insulin and EGF receptors (Tappia et. al.; Biochem J 1993 May 15;292 (Pt 1): 1–5). A number of phosphatases have been demonstrated to play a role in cancer, for eg. PTP zeta; a membrane phosphatase; is expressed in brain and is also expressed by a glioblastoma cell line (Krueger et. al.; Proc Natl Acad Sci U S A 1992 Aug. 15;89(16):7417–21); rPTP alpha is expressed in breast tumors and correlates with tumor grade (Ardini et. al.; Oncogene 2000 Oct. 12;19(43):4979–87). This phosphatase (rPTP alpha) is also expressed by human prostate cancer cell lines, oral squamous cell carcinoma and was correlated with histological grade of the oral tumor (Zelivianski et. al.; Mol Cell Biochem 2000 May;208(1–2):11–8; Berndt et al.; Histochem Cell Biol 1999 May;111(5):399–403). PTP-1B has been suggested to play arole in diabetes and obesity (Kennedy et. al.; Biochem Pharmacol 2000 Oct. 1;60(7):877–83) whle mutations in a PTP named EPM2A have been suggested as the cause of Lafora's disease (and autosomal recessive form of progressive myoclonus epilepsy) (Minassian et. al. Nat Genet 1998 October;20(2):171–4). Given the wide ranging effects of this family of proteins, we hypothesize that the novel protein described in this application plays a role in cancer, neurological, immune and metabolic diseases.

The disclosed NOV2 nucleic acid of the invention encoding a Protein tyrosine phosphatase precursor-like protein includes the nucleic acid whose sequence is provided in Table 2A, 2C, or 2E or a fragment thereof. The invention also includes a mutant or variant nucleic acid any of whose bases may be changed from the corresponding base shown in Table 2A, 2C, or 2E while still encoding a protein that maintains its Protein tyrosine phosphatase precursor like activities and physiological functions, or a fragment of such a nucleic acid. The invention further includes nucleic acids whose sequences are complementary to those just described, including nucleic acid fragments that are complementary to any of the nucleic acids just described. The invention additionally includes nucleic acids or nucleic acid fragments, or complements thereto, whose structures include chemical modifications. Such modifications include, by way of nonlimiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject. In the mutant or variant nucleic acids, and their complements, up to about 16 percent of the bases may be so changed.

The disclosed NOV2 protein of the invention includes the Protein tyrosine phosphatase precursor-like protein whose sequence is provided in Table 2B, 2D, or 2F. The invention also includes a mutant or variant protein any of whose residues may be changed from the corresponding residue shown in Table 2B, 2D, or 2F while still encoding a protein that maintains its Protein tyrosine phosphatase precursor-like activities and physiological functions, or a functional fragment thereof. In the mutant or variant protein, up to about 18 percent of the residues may be so changed.

The invention further encompasses antibodies and antibody fragments, such as $F_{ab}$ or $(F_{ab})_2$, that bind immunospecifically to any of the proteins of the invention.

The above defined information for this invention suggests that this Protein tyrosine phosphatase precursor-like protein (NOV2) may function as a member of a "Protein tyrosine pbosphatase precursor family". Therefore, the NOV2 nucleic acids and proteins identified here may be useful in potential therapeutic applications implicated in (but not limited to) various pathologies and disorders as indicated below. The potential therapeutic applications for this invention include, but are not limited to: protein therapeutic, small molecule drug target, antibody target (therapeutic, diagnostic, drug targeting/cytotoxic antibody), diagnostic and/or prognostic marker, gene therapy (gene delivery/gene ablation), research tools, tissue regeneration in vivo and in vitro of all tissues and cell types composing (but not limited to) those defined here.

The NOV2 nucleic acids and proteins of the invention are useful in potential therapeutic applications implicated in cancer including but not limited to various pathologies and disorders as indicated below. For example, a cDNA encoding the Protein tyrosine phosphatase precursor-like protein (NOV2) may be useful in gene therapy, and the Protein tyrosine phosphatase precursor-like protein (NOV2) may be useful when administered to a subject in need thereof. By way of nonlimiting example, the compositions of the present invention will have efficacy for treatment of patients suffering from cancer, kidney cancer, trauma, regeneration (in vitro and in vivo), viral/bacterial/parasitic infections, nephrological diseases including diabetes, autoimmune disease, renal artery stenosis, interstitial nephritis, glomerulonephritis, polycystic kidney disease, systemic lupus erythematosus, renal tubular acidosis, IgA nephropathy, hypercalceimia, Lesch-Nyhan syndrome, Hirschsprung's disease, Crohn's Disease, appendicitis, or other pathologies or conditions. The NOV2 nucleic acid encoding the Protein tyrosine phosphatase precursor-like protein of the invention, or fragments thereof, may further be useful in diagnostic applications, wherein the presence or amount of the nucleic acid or the protein are to be assessed.

NOV2 nucleic acids and polypeptides are further useful in the generation of antibodies that bind immuno-specifically to the novel NOV2 substances for use in therapeutic or diagnostic methods. These antibodies may be generated according to methods known in the art, using prediction from hydrophobicity charts, as described in the "Anti-NOVX Antibodies" section below. The disclosed NOV2 proteins have multiple hydrophilic regions, each of which can be used as an immunogen. In one embodiment, a contemplated NOV2 epitope is from about amino acids 1 to 100. In another embodiment, a NOV2 epitope is from about amino acids 200 to 300. In further embodiments, a NOV2 epitope is from about amino acids 450 to 500, from about amino acids 600 to 900, from about amino acids 950 to 1000, from about amino acids 1200 to 1300, from about amino acids 1400 to 1600, from about amino acids 1800 to 1900, from about amino acids 1950 to 2050, and from about amino acids 2200 to 2300. These novel proteins can be used in assay systems for functional analysis of various human disorders, which will help in understanding of pathology of the disease and development of new drug targets for various disorders.

NOV3

A disclosed NOV3 nucleic acid of 4538 nucleotides (also referred to as 134899552_EXT) encoding a novel human homolog of the *Drosophila* pecanex-like protein is shown in Table 3A. An open reading frame was identified beginning with an ATG initiation codon at nucleotides 101–103 and ending with a TGA codon at nucleotides 4439–4441. A putative untranslated region upstream from the initiation codon and downstream from the termination codon is underlined in Table 3A, and the start and stop codons are in bold letters.

TABLE 3A

NOV3 nucleotide sequence.

(SEQ ID NO:11)
CATGAAGGAAAAATTCTGAGTATTCTAATGGCTTTTTAAAATAATCATTTATTTGCTAGGTAAGTTCTCTTC

TACGCTGTATGAGACTGGTGGCTGTGATATGTCACTTGTGAATTTTGAACCAGCAGCAAGAAGAGCATCCAA

TATCTGGGACACAGATTCTCATGTATCCAGTTCTACCTCAGTTCGATTTTATCCACATGATGTGATTCGATT

GAATAGACTATTGACCATTGATACAGATTTGTTGGAGCAACAGGACATTGATCTAAGCCCTGACTTGGCAGC

TACTTACGGCCCAACAGAAGAAGCTGCCCAAAAGGTTAAACACTATTATCGCTTTTGGATCCTACCCCAGCT

GTGGATTGGCATTAACTTTGACAGACTCACACTTTTGGCCCTGTTTGATAGGAATCGTGAGATCCTGGAAAA

TGTGTTAGCTGTCATCCTGGCTATTCTCGTGGCCTTTTTGGGATCTATTCTTCTCATACAAGGATTCTTCAG

AGATATCTGGGTCTTCCAGTTCTGCCTCGTCATAGCCAGCTGTCAATACTCACTGCTTAAGAGTGTTCAACC

AGATTCTTCTTCTCCCAGACATGGTCATAATCGTATCATTGCCTACAGTAGACCAGTTTATTTCTGCATATG

TTGCGGTCTTATTTGGCTCTTGGATTATGGTAGCAGAAACCTGACTGCAACCAAGTTCAAATTATATGGAAT

AACTTTCACCAATCCACTGGTGTTTATATCAGCCAGGGATTTAGTTATAGTGTTTACACTCTGTTTCCCAAT

AGTGTTTTTCATTGGTCTCCTGCCTCAGGTGAATACATTTGTAATGTACCTTTGTGAACAATTGGATATTCA

TATTTTTGGTGGTAATGCCACTACAAGCCTGCTTGCAGCACTTTACAGTTTTATCTGTAGCATTGTTGCAGT

AGCCTTATTGTATGGATTATGTTATGGGCTTTACAGGATTCTTGGGATGGCCAGCATATTCCAGTACTTTT

CTCCATTTTTTGTGGTTTATTAGTGGCAGTGTCTTACCATCTCAGCCGACAAAGCAGTGATCCATCTGTACT

TABLE 3A-continued

NOV3 nucleotide sequence.

TAGCTCTTTAGTGCAATCCAAGATTTTTCCAAAAACGGAAGAGAAAAATCCAGAAGACCCTCTATCTGAAGT
AAAAGATCCACTGCCTGAAAAACTTAGAAATTCTGTTAGTGAGCGATTACAGTCTGACCTGGTAGTATGCAT
TGTAATTGGTGTGCTGTATTTTGCTATTCATGTAAGCACAGTCTTCACAGTATTGCAGCCTGCCCTCAAGTA
TGTGTTGTATACATTGGTTGGCTTTGTGGGTTTTGTAACCCATTATGTGCTGCCTCAAGTTAGAAAACAGCT
ACCATGGCACTGTTTCTCTCATCCTCTGCTAAAGACACTAGAGTATAATCAGTATGAAGTTCGAGATGCAGC
CACTATGATGTGGTTTGAGAAACTTCATGTGTGGCTTCTTTTTGTGGAGAAGAATATAATCTATCCATTGAT
TGTTCTCAATGAACTGAGCAGCAGTGCAGAGACAATTGCTAGTCCAAAGAAACTGAATACAGAGTTAGGTGC
TTTAATGATCACTGTTGCTGGTTTGAAGTTGCTACGATCCTCTTTTAGCAGCCCTACATATCAGTATGTTAC
AGTCATCTTTACTGTGCTGTTTTTCAAATTTGACTATGAAGCTTTTTCAGAGACCATGCTGTTGGATCTCTT
CTTTATGTCCATACTCTTCAACAAGCTTTGGGAACTACTTTATAAATTGCAGTTTGTGTATACCTATATTGC
CCCATGGCAGATCACATGGGGTTCTGCTTTCCATGCTTTTGCTCAGCCTTTTGCAGTGCCTCGTTCAGCCAT
GCTGTTTATTCAGGCTGCTGTCTCGGCCTTCTTCTCTACTCCACTGAACCCCTTTCTGGGAAGTGCAATATT
CATCACTTCATATGTCCGACCTGTGAAATTCTGGGAGAGAGACTATAGCACAAAACGAGTGGATCATTCAAA
TACCAGATTGGCTTCCCAGCTTGATAGAAATCCAGGTTCAGATGACAACAATCTGAATTCCATCTTTTATGA
GCATTTAACTAGATCCCTACAGCACAGCCTCTGTGGTGATTTGCTACTAGGACGGTGGGGAAACTACAGTAC
AGGGGACTGTTTCATCCTTGCCTCTGACTATCTCAATGCATTAGTACACCTTATAGAGATAGGCAATGGTCT
GGTCACTTTTCAGCTGCGGGACTTGAATTCAGAGGTACCTACTGTCAACAACGGGAAGTGGAGGCCATTAC
TGAAGGTGTAGAGGAAGATGAAGGATTTTGCTGTTGTGAACCTGGCCATATTCCTCACATGCTTTCATTTAA
TGCTGCATTTAGCCAGCGATGGCTAGCTTGGGAAGTGATAGTCACAAAGTACATTCTGGAGGGTTATAGCAT
CACTGATAACAGTGCTGCTTCTATGCTTCAAGTCTTTGATCTTCGGAAAGTACTCACCACTTACTATGTCAA
GGGTATCATTTATTATGTTACGACCTCGTCTAAGCTAGAGGAGTGGCTAGCTAATGAGACAATGCAGGAAGG
ACTTCGTCTGTGTGCTGATCGCAATTATGTCGATGTGGACCCGACCTTTAATCCAAACATTGATGAAGACTA
TGACCACCGACTGGCAGGCATATCTAGGGAGAGTTTCTGTGTGATTTACCTCAACTGGATAGAGTACTGCTC
TTCCCGAAGAGCAAAGCCTGTGGATGTGGACAAAGATTCATCCCTAGTGACTCTCTGTTATGGACTCTGTGT
TCTGGGACGGAGAGCTTTGGGGACTGCATCCCATCATATGTCCAGTAATTTAGAGTCATTCCTCTATGGATT
GCATGCCCTATTTAAAGGAGATTTCCGTATTTCTTCAATTCGAGATGAATGGATCTTTGCTGACATGGAATT
GCTAAGAAAAGTAGTAGTCCCTGGGATCCGTATGTCCATTAAACTTCATCAGGATCATTTTACTTCTCCAGA
TGAATATGATGACCCTACTGTGCTCTATGAAGCCATAGTATCTCATGAGAAGAACCTCGTAATAGCCCATGA
AGGGGACCCTGCATGGCGGAGTGCAGTACTTGCCAACTCTCCCTCCTTGCTTGCTCTGCGGCATGTCATGGA
TGATGGCACCAATGAATATAAAATCATCATGCTCAACAGACGCTACCTGAGCTTCAGGGTCATTAAAGTGAA
TAAGGAATGTGTCCGAGGTCTTTGGGCAGGGCAACAGCAGGAGCTTGTTTTTCTACGTAACCGTAACCCAGA
GAGAGGTAGCATCCAAAATGCAAAGCAAGCCCTGAGAAACATGATAAACTCATCTTGTGATCAACCTATTGG
CTACCCAATCTTTGTCTCACCCCTGACAACTTCTTACTCTGACAGCCACGAACAGCTTAAAGACATTCTTGG
GGGTCCTATCAGCTTGGGAAATATCAGGAACTTCATAGTGTCAACCTGGCACAGGCTTAGGAAAGGTTGCGG
AGCTGGATGTAACAGTGGTGGCAATATTGAAGATTCTGATACTGGAGGTGGGACTTCCTGCACTGGTAACAA
TGCAACAACTGCCAACAATCCCCACAGCAACGTGACCCAGGGAAGCATTGGAAATCCTGGGCAGGGATCAGG
AACTGGACTCCACCCACCTGTCACATCTTATCCTCCAACACTAGGTACTAGCCACAGCTCTCACTCTGTGCA
GTCGGGCCTGGTCAGACAGTCTCCTGCCCGGGCCTCAGTAGCCAGCCAGTCTTCCTACTGCTATAGCAGCCG
GCATTCATCCCTCCGGATGTCCACCACTGGGTTTGTGCCTTGTCGGCGCTCTTCTACTAGTCAGATATCGCT

TABLE 3A-continued

NOV3 nucleotide sequence.

TCGAAACTTGCCATCATCCATCCAATCCCGACTGTCGATGGTGAACCAAATGGAACCCTCAGGTCAGAGCGG

CCTGGCCTGTGTGCAGCACGGCCTGCCTTCCTCCAGCAGCTCCAGCCAAAGCATCCCAGCCTGCAAACATCA

CACTCTCGTGGGCTTTCTTGCGACAGAGGGAGGTCAGAGCAGTGCCACTGATGCACAGCCAGGCAACACCTT

AAGTCCTGCCAACAATTCACACTCCAGAAAGGCAGAAGTGATTTACAGAGTCCAAATTGTGGATCCCAGTCA

AATTCTGGAAGGGATCAACCTGTCTAAAAGGAAAGAGCTACAGTGGCCTGATGAAGGAATCCGGTTAAAAGC

TGGGAGAAATAGCTGGAAAGACTGGAGTCCGCAGGAGGGCATGGAAGGCCATGTGATTCACCGATGGGTGCC

TTGCAGCAGAGATCCAGGTACCAGATCCCACATCGACAAGGCAGTGCTTCTGGTCCAGATTGATGATAAATA

TGTGACTGTAATTGAAACTGGGGTACTAGAACTTGGGGCTGAAGTGTGAGCCAGTGTTTATTATAAAGACAT

TTCTTTTTCCCTCTCAATTCCAAGGCATTGGAAAAAGAGAGGAACAAGCAGAAGATGCCTGCAGGTATCACT

TT

The disclosed NOV3 nucleic acid sequence, localized to chromsome 14, has 2277 of 2283 bases (99%) identical to a gb:GENBANK-ID:AB018348|acc:AB018348.1 mRNA from *Homo sapiens* (*Homo sapiens* mRNA for KIAA0805 protein, partial cds) (E=0.0).

A NOV3 polypeptide (SEQ ID NO:12) encoded by SEQ ID NO:11 has 1446 amino acid residues and is presented using the one-letter code in Table 3B. Signal P, Psort and/or Hydropathy results predict that NOV3 does not contain a signal peptide and is likely to be localized to the plasma membrane with a certainty of 0.8000. In other embodiments, NOV3 may also be localized to the mitochondrial inner membrane with a certainty of 0.4714, the Golgi body with a certainty of 0.4000, or the endoplasmic reticulum (membrane) with a certainty of 0.3000.

TABLE 3B

Encoded NOV3 protein sequence.

(SEQ ID NO:12)
MSLVNFEPAARRASNIWDTDSHVSSSTSVRFYPHDVIRLNRLLTIDTDLLEQQDIDLSPDLAATYGPTEEAA

QKVKHYYRFWILPQLWIGINFDRLTLLALFDRNREILENVLAVILAILVAFLGSILLIQGFFRDIWVFQFCL

VIASCQYSLLKSVQPDSSSPRHGHNRIIAYSRPVYFCICCGLIWLLDYGSRNLTATKFKLYGITFTNPLVFI

SARDLVIVFTLCFPIVFFIGLLPQVNTFVMYLCEQLDIHIFGGNATTSLLAALYSFICSIVAVALLYGLCYG

ALQDSWDGQHIPVLFSIFCGLLVAVSYHLSRQSSDPSVLSSLVQSKIFPKTEEKNPEDPLSEVKDPLPEKLR

NSVSERLQSDLVVCIVIGVLYFAIHVSTVFTVLQPALKYVLYTLVGFVGFVTHYVLPQVRKQLPWHCFSHPL

LKTLEYNQYEVRDAATMMWFEKLHVWLLFVEKNIIYPLIVLNELSSSAETIASPKKLNTELGALMITVAGLK

LLRSSFSSPTYQYVTVIFTVLFFKFDYEAFSETMLLDLFFMSILFNKLWELLYKLQFVYTYIAPWQITWGSA

FHAFAQPFAVPRSAMLFIQAAVSAFFSTPLNPFLGSAIFITSYVRPVKFWERDYSTKRVDHSNTRLASQLDR

NPGSDDNNLNSIFYEHLTRSLQHSLCGDLLLGRWGNYSTGDCFILASDYLNALVHLIEIGNGLVTFQLRGLE

FRGTYCQQREVEAITEGVEEDEGFCCCEPGHIPHMLSFNAAFSQRWLAWEVIVTKYILEGYSITDNSAASML

QVFDLRKVLTTYYVKGIIYYVTTSSKLEEWLANETMQEGLRLCADRNYVDVDPTFNPNIDEDYDHRLAGISR

ESFCVIYLNWIEYCSSRRAKPVDVDKDSSLVTLCYGLCVLGRRALGTASHHMSSNLESFLYGLHALFKGDFR

ISSIRDEWIFADMELLRKVVVPGIRMSIKLHQDHFTSPDEYDDPTVLYEAIVSHEKNLVIAHEGDPAWRSAV

LANSPSLLALRHVMDDGTNEYKIIMLNRRYLSFRVIKVNKECVRGLWAGQQQELVFLRNRNPERGSIQNAKQ

ALRNMINSSCDQPIGYPIFVSPLTTSYSDSHEQLKDILGGPISLGNIRNFIVSTWHRLRKGCGAGCNSGGNI

EDSDTGGGTSCTGNNATTANNPHSNVTQGSIGNPGQGSGTGLHPPVTSYPPTLGTSHSSHSVQSGLVRQSPA

RASVASQSSYCYSSRHSSLRMSTTGFVPCRRSSTSQISLRNLPSSIQSRLSMVNQMEPSGQSGLACVQHGLP

TABLE 3B-continued

Encoded NOV3 protein sequence.

SSSSSSQSIPACKHHTLVGFLATEGGQSSATDAQPGNTLSPANNSHSRKAEVIYRVQIVDPSQILEGINLSK

RKELQWPDEGIRLKAGRNSWKDWSPQEGMEGHVIHRWVPCSRDPGTRSHIDKAVLLVQIDDKYVTVIETGVL

ELGAEV

The disclosed NOV3 amino acid sequence has 1355 of 1446 amino acid residues (93%) identical to, and 1409 of 1446 amino acid residues (97%) similar to, the 1446 amino acid residue ptnr:SPTREMBL-ACC:Q9QYC1 protein from *Mus musculus* (Mouse) (PECANEX 1) (E=0.0).

NOV3 is expressed in at least Pancreas, Parathyroid Gland, Thyroid, Mammary gland/Breast, Ovary, Placenta, Uterus, Colon, Liver, Bone Marrow, Lymphoid tissue, Spleen, Tonsils, Prostate, Testis, Brain, Lung, and Kidney. This information was derived by determining the tissue sources of the sequences that were included in the invention including but not limited to SeqCalling sources, Public EST sources, Literature sources, and/or RACE sources.

In addition, NOV3 is predicted to be expressed in *Homo sapiens* heart, melanocyte, B-cells, larynx, skin, CNS, and multiple sclerosis lesions because of the expression pattern of the following sequences (which are publicly availabel ESTS for the sequence of the invention) AB018348, BE881203, BE867469, BE867415, AB007895, NM_014801, U74315, BE880986, W500099, AW250617, AA426168, AW246742, AA284182, W46420, H14491, Z44921, BE930588, AI922381, AI215559, AA923742, AA582883, BE797814, N75143, BE049421, F07632, BE797239, AI168579, AV653955, BE065657, AL079849, and BE767656, closely related *Homo sapiens* mRNA for KIAA proteins, partial cds homolog.

NOV3 also has homology to the amino acid sequences shown in the BLASTP data listed in Table 3C.

TABLE 3C

BLAST results for NOV3

| Gene Index/ Identifier | Protein/Organism | Length (aa) | Identity (%) | Positives (%) | Expect |
|---|---|---|---|---|---|
| ref\|XP_027243.1\| (XM_027243) | hypothetical protein XP_027243 [*Homo sapiens*] | 619 | 619/619 (100%) | 619/619 (100%) | 0.0 |
| gi\|15076843\|gb\|AAK82958.1\|AF233450_1 (AF233450) | pecanex-like protein 1 [*Homo sapiens*] | 2341 | 1372/1451 (94%) | 1376/1451 (94%) | 0.0 |
| gi\|6650377\|gb\|AAF21809.1\|AF096286_1 (AF096286) | pecanex 1 [*Mus musculus*] | 1446 | 1296/1446 (89%) | 1344/1446 (92%) | 0.0 |
| gi\|13171105\|gb\|AAK13590.1\|AF154413_1 (AF154413) | pecanex [*Takifugu rubripes*] | 1703 | 1079/1466 (73%) | 1204/1466 (81%) | 0.0 |
| gi\|7290294\|gb\|AAF45755.1\| (AE003423) | pcx gene product [alt 1] [*Drosophila melanogaster*] | 3437 | 320/554 (57%) | 424/554 (75%) | 0.0 |

The homology of these sequences is shown graphically in the ClustalW analysis shown in Table 3D.

TABLE 3D

ClustalW Analysis of NOV3

1) NOV3 (SEQ ID NO:12)
2) ref|XP_027243.1| (XM_027243) hypothetical protein XP_027243 [*Homo sapiens*] (SEQ ID NO:42)
3) gi|15076843|gb|AAK82958.1|AF233450_1 (AF233450) pecanex-like protein 1 [*Homo sapiens*] (SEQ ID NO:43)
4) gi|6650377|gb|AAF21809.1|AF096286_1 (AF096286) pecanex 1 [*Mus musculus*] (SEQ ID NO:44)
5) gi|13171105|gb|AAK13590.1|AF154413_1 (AF154413) pecanex [*Takifugu rubripes*] (SEQ ID NO:45)

TABLE 3D-continued

ClustalW Analysis of NOV3

6) gi|7290294|gb|AAF45755.1| (AE03423) pcx gene product [alt 1] [*Drosophila melanogaster*] (SEQ ID NO:46)

```
                       10        20        30        40        50        60
                ....|....|....|....|....|....|....|....|....|....|....|....|
NOV3            ------------------------------------------------------------ 1
ref|XP_027243.1 ------------------------------------------------------------ 1
gi|15076843|gb| MGSQTLQILRQGVWAALSGGWYYDPHQATFVNALHLYLWLFLLGLPFTLYMALPSTMIIV 60
gi|6650377|gb|A ------------------------------------------------------------ 1
gi|13171105|gb| MGSQTLQILRQGVWASVTGGWYYDPDQNTFVNALHLYIWLFLLVFPFTLYMALQPSMVIV 60
gi|7290294|gb|A ------------------------------------------------------------ 1

70        80        90       100       110       120
                ....|....|....|....|....|....|....|....|....|....|....|....|
NOV3            ------------------------------------------------------------ 1
ref|XP_027243.1 ------------------------------------------------------------ 1
gi|15076843|gb| AVYCPVIAAVFIVLKMVNYRLHRALDAGEVVDRTANEFTDQR-TKAEQGNVSTRRKDSNG 119
gi|6650377|gb|A ------------------------------------------------------------ 1
gi|13171105|gb| GIYCGVIAAMFLLLKTVNYRLHHALDEGEVVEHQTRESKGSRGGTGGANDPVTRREDSNG 120
gi|7290294|gb|A ------------------------------------------------------------ 1

130       140       150       160       170       180
                ....|....|....|....|....|....|....|....|....|....|....|....|
NOV3            ------------------------------------------------------------ 1
ref|XP_027243.1 ------------------------------------------------------------ 1
gi|15076843|gb| PSDPGGGIEMSEFIREATPPVGCSSRNSYAGLDPSNQIGSGSSRLGTAATIKGDTDTAKT 179
gi|6650377|gb|A ------------------------------------------------------------ 1
gi|13171105|gb| LGDPGGGIEMADFIRQETPPVDCSSRNSYVG----------------------------- 151
gi|7290294|gb|A ------------------------------------------------------------ 1

190       200       210       220       230       240
                ....|....|....|....|....|....|....|....|....|....|....|....|
NOV3            ------------------------------------------------------------ 1
ref|XP_027243.1 ------------------------------------------------------------ 1
gi|15076843|gb| SDDISLSLGQSSSLCKEGSEEQDLAADRKLFRLVSNDSFISIQPSLSSCGQDLPRDFSDK 239
gi|6650377|gb|A ------------------------------------------------------------ 1
gi|13171105|gb| ------------------------------------------------------------ 151
gi|7290294|gb|A ------------------------------------------------------------ 1

250       260       270       280       290       300
                ....|....|....|....|....|....|....|....|....|....|....|....|
NOV3            ------------------------------------------------------------ 1
ref|XP_027243.1 ------------------------------------------------------------ 1
gi|15076843|gb| VNLPSHNHHHHVDQSLSSACDTEVASLVPLHSHSYRKDHRPRGVPRTSSSAVAFPDTSLN 299
gi|6650377|gb|A ------------------------------------------------------------ 1
gi|13171105|gb| ------------------------------------------------------------ 151
gi|7290294|gb|A ------------------------------------------------------------ 1

310       320       330       340       350       360
                ....|....|....|....|....|....|....|....|....|....|....|....|
NOV3            ------------------------------------------------------------ 1
ref|XP_027243.1 ------------------------------------------------------------ 1
gi|15076843|gb| DFPLYQQRRGLDPVSELESSKPLSGSKESLVENSGLSGEFQLAGDLKINTSQPPTKSGKS 359
gi|6650377|gb|A ------------------------------------------------------------ 1
gi|13171105|gb| ------------------------------------------------------------ 151
gi|7290294|gb|A ------------------------------------------------------------ 1

370       380       390       400       410       420
                ....|....|....|....|....|....|....|....|....|....|....|....|
NOV3            ------------------------------------------------------------ 1
ref|XP_027243.1 ------------------------------------------------------------ 1
gi|15076843|gb| KPLKAEKSMDSLRSLSTRSSGSTESYCSGTDRDTNSTVSSYKSEQTSSTHIESILSEHEE 419
gi|6650377|gb|A ------------------------------------------------------------ 1
gi|13171105|gb| ---------------------------------------------------------MDL 154
gi|7290294|gb|A ------------------------------------------------------------ 1

430       440       450       460       470       480
                ....|....|....|....|....|....|....|....|....|....|....|....|
NOV3            ------------------------------------------------------------ 1
ref|XP_027243.1 ------------------------------------------------------------ 1
gi|15076843|gb| SPKAGTKSGRKKECCAGPEEKNSCASDKRTSSEKIAMEASTNSGVHEAKDPTPSDEMHNQ 479
gi|6650377|gb|A ------------------------------------------------------------ 1
gi|13171105|gb| NQRMSSTHGRTTVAKAPG------------------------------------------ 172
gi|7290294|gb|A ------------------------------------------------------------ 1
```

TABLE 3D-continued

ClustalW Analysis of NOV3

```
                        490       500       510       520       530       540
                   ....|....|....|....|....|....|....|....|....|....|....|....|
NOV3               ------------------------------------------------------------   1
ref|XP_027243.1    ------------------------------------------------------------   1
gi|15076843|gb|    RGLSTSASEEANKNPHANEFTSQGDRPPGNTAENKEEKSDKSAVSVDSKVRKDVGGKQKE 539
gi|6650377|gb|A    ------------------------------------------------------------   1
gi|13171105|gb|    ------------------------------------------------------------ 172
gi|7290294|gb|A    ------------------------------------------------------------   1

550       560       570       580       590       600
                   ....|....|....|....|....|....|....|....|....|....|....|....|
NOV3               ------------------------------------------------------------   1
ref|XP_027243.1    ------------------------------------------------------------   1
gi|15076843|gb|    GDVRPKSSSVIHRTASAHKSGRRRTGKKRASSFDSSRHRDYVCFRGVSGTKPHSAIFCHD 599
gi|6650377|gb|A    ------------------------------------------------------------   1
gi|13171105|gb|    ---------------------------------S-------------------------- 173
gi|7290294|gb|A    ------------------------------------------------------------   1

610       620       630       640       650       660
                   ....|....|....|....|....|....|....|....|....|....|....|....|
NOV3               ------------------------------------------------------------   1
ref|XP_027243.1    ------------------------------------------------------------   1
gi|15076843|gb|    EDSSDQSDLSRASSVQSAHQFSSDSSSSTTSHSCQSPEGRYSALKTKHTHKERGTDSEHT 659
gi|6650377|gb|A    ------------------------------------------------------------   1
gi|13171105|gb|    ------------------------------------------------------------ 173
gi|7290294|gb|A    ------------------------------------------------------------   1

670       680       690       700       710       720
                   ....|....|....|....|....|....|....|....|....|....|....|....|
NOV3               ------------------------------------------------------------   1
ref|XP_027243.1    ------------------------------------------------------------   1
gi|15076843|gb|    HKAHLVPEGTSKKRATRRTSSTNSAKTRARVLSLDSGTVACLNDSNRLMAPESIKPLTTS 719
gi|6650377|gb|A    ------------------------------------------------------------   1
gi|13171105|gb|    ------------------------------------------------------------ 173
gi|7290294|gb|A    ------------------------------------------------------------   1

730       740       750       760       770       780
                   ....|....|....|....|....|....|....|....|....|....|....|....|
NOV3               ------------------------------------------------------------   1
ref|XP_027243.1    ------------------------------------------------------------   1
gi|15076843|gb|    KSDLEAKEGEVLDELSLLGRASQLETVTRSRNSLPNQVAFPEGEEQDAVSGAAQASEEAV 779
gi|6650377|gb|A    ------------------------------------------------------------   1
gi|13171105|gb|    --------------------------------------------------------EETV 177
gi|7290294|gb|A    ------------------------------------------------------------   1

790       800       810       820       830       840
                   ....|....|....|....|....|....|....|....|....|....|....|....|
NOV3               ------------------------------------------------------------   1
ref|XP_027243.1    ------------------------------------------------------------   1
gi|15076843|gb|    SFRRERSTFRRQAVRRRHNAGSNPTPPTLLIGSPLSLQDGQQGQQSTAQ------VKVQS 833
gi|6650377|gb|A    ------------------------------------------------------------   1
gi|13171105|gb|    IFRRERSTFRRQAVRRRHNAGSNPTPPTSLIGSPLRYALHEADRPSGVRSWYRTVKSQPS 237
gi|7290294|gb|A    ------------------------------------------------------------   1

850       860       870       880       890       900
                   ....|....|....|....|....|....|....|....|....|....|....|....|
NOV3               ---------------------------------------------------------MSL   3
ref|XP_027243.1    ------------------------------------------------------------   1
gi|15076843|gb|    RPPSQAAVLSASASLLVRNGSVHLEASHDNASAVGGSSLHDELGKFSSTLYETGGCDMSL 893
gi|6650377|gb|A    ---------------------------------------------------------MSL   3
gi|13171105|gb|    RTPSQVTVLSTSASLLARNGSTHLEGSQDKASTVGTTSLQDEFGTLTPSLYEIRGCHIGL 297
gi|7290294|gb|A    ------------------------------------------------------------   1

910       920       930       940       950       960
                   ....|....|....|....|....|....|....|....|....|....|....|....|
NOV3               VNFEPAARRASN-IWDTDSHVSSSTSVTFYPHDVI-----RLNRLLTIDTDLLEQQDIDL  57
ref|XP_027243.1    ------------------------------------------------------------   1
gi|15076843|gb|    VNFEPAARRASN-ICDTDSHVSSSTSVTFYPHDVISLPQIRLNRLLTIDTDLLEQQDIDL 952
gi|6650377|gb|A    VNFEPAARRASN-ICDTDSHVSSSTSVTFYPHDMIR-----LNRLLTIDTDLLEQQDIDL  57
gi|13171105|gb|    GNFESATRRASNNIWDTDSHISSSTSVTFYPHDLISLHHIRANRLLTMDPELLEQQD-DL 356
gi|7290294|gb|A    ------------------------------------------------------------   1

970       980       990       1000      1010      1020
                   ....|....|....|....|....|....|....|....|....|....|....|....|
NOV3               SPDLAAT-----YGPTEEAAQKVKHYYTFWRLPQLWIGINFDRLTLLALFDRNREILENV 112
ref|XP_027243.1    ------------------------------------------------------------   1
gi|15076843|gb|    SPDLAAT-----YGPTEEAAQKVKHYYTFWRLPQLWIGINFDRLTLLALFDRNREILENV 1007
gi|6650377|gb|A    SPDLAAT-----YGPTEEAAQKVKHYYTFWRLPQLWIGINFDRLTLLALFDRNREILENI 112
gi|13171105|gb|    SPDLQDAPLGQDNPSAASAAKTRQYYTLWRLPFLWVGLHFDRLTLLALFDRNREVLENV 416
gi|7290294|gb|A    ------------------------------------------------------------   1
```

TABLE 3D-continued

ClustalW Analysis of NOV3

```
                    1030      1040      1050      1060      1070      1080
                 ....|....|....|....|....|....|....|....|....|....|....|....|
NOV3             LAVILATLVAFLGSILLIQGFFRDIWVFQFCLVIASCQYSLLKSVQPDSSSPRHGHNRII  172
ref|XP_027243.1  ------------------------------------------------------------    1
gi|15076843|gb|  LAVILATLVAFLGSILLIQGFFRDIWVFQFCLVIASCQYSLLKSVQPDSSSPRHGHNRII 1067
gi|6650377|gb|A  LAVVLATLVAFLGSILLIQGFFRDIWVFQFCLVIASCQYSLLKSVQPDSSSPRHGHNRII  172
gi|13171105|gb|  LAVVLAVLVAFLGSVLLIHGFFADIWVFQFCLVIASCQYSLLKSVQPDSSSPRHGHNRII  476
gi|7290294|gb|A  ------------------------------------------------------------    1

1090      1100      1110      1120      1130      1140
                 ....|....|....|....|....|....|....|....|....|....|....|....|
NOV3             AYSRPVYFCRCCGLIWLLDYGSRNLTATKFKLYGITFTNPLVFISARDLVIVFTLCFPIV  232
ref|XP_027243.1  ------------------------------------------------------------    1
gi|15076843|gb|  AYSRPVYFCRCCGLIWLLDYGSRNLTATKFKLYGITFTNPLVFISARDLVIVFTLCFPIV 1127
gi|6650377|gb|A  AYSRPVYFCRCCGLIWLLDYGSRNLTTSKFKLYGVTFTNPLVLLSARDLVIVFTLCFPIV  232
gi|13171105|gb|  AYSRPVYFCRCCGLIWLLHYGSLRTISSRFTLYGVALTSSLVLASARDLVIVFTLCFPII  536
gi|7290294|gb|A  ------------------------------------------------------------    1

1150      1160      1170      1180      1190      1200
                 ....|....|....|....|....|....|....|....|....|....|....|....|
NOV3             FFIGLLPQVNTFVMYLCEQLDIHIFGGNATTSLLAALYSFICSIVAVALLYGLCYGALQD  292
ref|XP_027243.1  ------------------------------------------------------------    1
gi|15076843|gb|  FFIGLLPQVNTFVMYLCEQLDIHIFGGNATTSLLAALYSFICSIVAVALLYGLCYGALRD 1187
gi|6650377|gb|A  FFIGLLPQVNTFVMYLCEQLDIHIFGGNATTSLLAALYSFICSIVAVALLYGLCYGALRD  292
gi|13171105|gb|  FFVGLLPQVNTFVMYLFEQLDIHVFGGNASTSLLSALYSILRSIVTVALLYCFCYGALKK  596
gi|7290294|gb|A  ------------------------------------------------------------    1

1210      1220      1230      1240      1250      1260
                 ....|....|....|....|....|....|....|....|....|....|....|....|
NOV3             SWDGQHIPVLFSIFCGLLVAVSYHLSRQSSDPSVISSLVQSKIFEKTEFKNPEDPLSEVK  352
ref|XP_027243.1  ------------------------------------------------------------    1
gi|15076843|gb|  SWDGQHIPVLFSIFCGLLVAVSYHLSRQSSDPSVIFSLVQSKIFEKTEFKNPEDPLSEVK 1247
gi|6650377|gb|A  SWDGQHVPVLFSIFCGLLVAVSYHLSRQSNDPSVIFSLMQSKIFEKADEKNPEDPLSEVK  352
gi|13171105|gb|  MWEPHIIPVLFSVFCGLLVAVSYHLSRQSSDPSVIMYVPLSKVFEQLRSKNPEDPLSEVQ  656
gi|7290294|gb|A  ------------------------------------------------------------    1

1270      1280      1290      1300      1310      1320
                 ....|....|....|....|....|....|....|....|....|....|....|....|
NOV3             DPLPEKIRNSVSERLQSDLVCIVIGVLYFAIHVSTVFTVLQPALKYVLYTIVGFVGFVT  412
ref|XP_027243.1  ------------------------------------------------------------    1
gi|15076843|gb|  DPLPEKIRNSVSERLQSDLVCIVIGVLYFAIHVSTVFTVLQPALKYVLYTIVGFVGFVT 1307
gi|6650377|gb|A  DPLPEKISNSVSERLQSDLVCVIIGVLYFAIHVSTVFTALQPALKYVLYALVGVVGLVT  412
gi|13171105|gb|  DPLPEKIRASVNERLQSDLIVCVVIAVLYFAIHVSTVFIALQPYLSYVLYCLLCGAVGLLT  716
gi|7290294|gb|A  ------------------------------------------------------------    1

1330      1340      1350      1360      1370      1380
                 ....|....|....|....|....|....|....|....|....|....|....|....|
NOV3             HYVLPQVRKQLPWHCFSHPLLKTLEYNQYEVRDAATMMWFEKLHVWLLFVEKNIYPLIV  472
ref|XP_027243.1  ------------------------------------------------------------    1
gi|15076843|gb|  HYVLPQVRKQLPWHCFSHPLLKTLEYNQYEVRNAATMMWFEKLHVWLLFVEKNIYPLIV 1367
gi|6650377|gb|A  HYVLPQVRKQLPWHCFSRPLLETABHSQYEVRDAAHVMWFEKFHVWLLFVEKNIYPLIV  472
gi|13171105|gb|  HYLLPQIRKQLPWYCFSHPLLKTKEYYQFEVRDAAHVMWFEKFHVWLLFVEKNVEYPLVI  776
gi|7290294|gb|A  ------------------------------------------------------------    1

1390      1400      1410      1420      1430      1440
                 ....|....|....|....|....|....|....|....|....|....|....|....|
NOV3             LNELSSSAETIASPKKLNTEEGALMITVAGLKLLRSSFSSPTYQYVTVIFTVLFFKFDYE  532
ref|XP_027243.1  ------------------------------------------------------------    1
gi|15076843|gb|  LNELSSSAETIASPKKLNTEEGALMITVAGLKLLRSSFSSPTYQYVTVIFTVLFFKFDYE 1427
gi|6650377|gb|A  LNELSSSAETIASPKKLNTEEGALMITVAGLKLLRSSFSSPTYQYVTVIFTVLFFKFDYE  532
gi|13171105|gb|  LNELSSSAETIASPKKLNTEEGALMITVAGLKLLRSSFSSPTYQYVTVIFTVLFFKFDYE  836
gi|7290294|gb|A  ------------------------------------------------------------    1

1450      1460      1470      1480      1490      1500
                 ....|....|....|....|....|....|....|....|....|....|....|....|
NOV3             AFSEIMLLDLFMSIKFNKLWEILYKLQFVYTYIAPWQITWGSAFHAFAQPFAVPRSAML  592
ref|XP_027243.1  ------------------------------------------------------------    1
gi|15076843|gb|  AFSEIMLLDLFMSIKFNKLWEILYKLQFVYTYIAPWQITWGSAFHAFAQPFAVPHSAML 1487
gi|6650377|gb|A  AFSEIMLLDLFMSIKFSKLWEILYKRQFVYTYIAPWQITWGSAFHAFAQPFAVPHSAML  592
gi|13171105|gb|  HLSEILLLDLFLMSIIFSKWEIFYKLHFVYTYIAPWQITWGSAFHAFAQPFAVPHSAML  896
gi|7290294|gb|A  ------------------------------------------------------------    1

1510      1520      1530      1540      1550      1560
                 ....|....|....|....|....|....|....|....|....|....|....|....|
NOV3             EIQAAVSAFFSTPLNPFLGSAIFITSYVRPVKFWERDYSTKRVDHSNTRLASQLDRNPGS  652
ref|XP_027243.1  ------------------------------------------------------------    1
gi|15076843|gb|  EIQAAVSAFFSTPLNPFLGSAIFITSYVRPVKFWERDYNTKRVDHSNTRLASQLDRNPGS 1547
gi|6650377|gb|A  EVQALVSAFFSTPLNPFLGSAIFITSYVRPVKFWERDYNTKRVDHSNTRLASQLDRNPGS  652
gi|13171105|gb|  EVQVVSSIFSTPLNPFLGSAIFITSYVRPVKFWERDYNKRVDHSNTRLASQLDRNPGS    956
gi|7290294|gb|A  -----MSTEESSPDSEYT-SAVPVDCRVTDEK----ENEMKQVDFDEDTRVLLVKQN---   47
```

TABLE 3D-continued

ClustalW Analysis of NOV3

```
                      1570      1580      1590      1600      1610      1620
                 ....|....|....|....|....|....|....|....|....|....|....|....|
NOV3             DDKNLNSIFYEHLTRSLQHSLCGDLLLGRWGNYSTGDCFILASDYLNALVHLIEIGNGLV  712
ref|XP_027243.1  ------------------------------------------------------------    1
gi|15076843|gb|  DDKNLNSIFYEHLTRSLQHSLCGDLLLGRWGNYSTGDCFILASDYLNALVHLIEIGNGLV 1607
gi|6650377|gb|A  DDKNLNSIFYEHLTRSLQHSLCGDLLLGRWGNYSTGDCFILASDYLNALVHLIEIGNGLV  712
gi|13171105|gb|  DDKNLNSIFYEHLTRSLQHSLCGDLLLGRWGNFSTGDCFILASDYLNALVHLIEIGNGLV 1016
gi|7290294|gb|A  RLLAVGAKCTHYGAPLQT---GALGLGRVRCPWHGACFNLENGDIEDFP-------GLD   97

1630      1640      1650      1660      1670      1680
                 ....|....|....|....|....|....|....|....|....|....|....|....|
NOV3             TFQLRGLEFRGTYCQQREVEAITEGVEEDEGFCCCEPGHIPHMLSFNAAFSQRWLAWEVI  772
ref|XP_027243.1  ------------------------------------------------------------    1
gi|15076843|gb|  TFQLRGLEFRGTYCQQREVEAITEGVEEDEGFCCCEPGHIPHMLSFNAAFSQRWLAWEVI 1667
gi|6650377|gb|A  TFQLRGLEFRGTYCQQREVEAITEGVEEDEGFCCCEPGHVPHVLSFNAAFSQRWLAWEVV  772
gi|13171105|gb|  TFQLRGLEFRGTYCQQREVEAITEGVEEDEGFCCCEPGHLPHILSFNAAFGQRWLAWEVV 1076
gi|7290294|gb|A  SLP---------------------------------------------------CYRVE  105

1690      1700      1710      1720      1730      1740
                 ....|....|....|....|....|....|....|....|....|....|....|....|
NOV3             VTKYSLEGYSITDNSAASMLQVPDLRKVLTTYYVKGIIYYVTTSSKLEEWLANETMQEGL  832
ref|XP_027243.1  ------------------------------------------------------MQEGL    5
gi|15076843|gb|  VTKYILEGYSITDNSAASMLQVPDLKKVLTTYYVKGIIYYVTTSSKLEEWLANETMQEGL 1727
gi|6650377|gb|A  VTKYSLEGYSITDNSAASMLQVPDLRKVLTTYYVKGIIYYVTTSSKLEEWLANETMQEGL  832
gi|13171105|gb|  VTKYVLEGYSITDNSAASMLQVPELRRILTTYYVKGIIYYVIASPKLEEWLANDTMKEGL 1136
gi|7290294|gb|A  VG---------NEGQ--------------VMLRAKRSDLVNNKRLKNMV  131

1750      1760      1770      1780      1790      1800
                 ....|....|....|....|....|....|....|....|....|....|....|....|
NOV3             RLCADRNYVDVDPTFNPI-IDEDYDHRLAGISRESFCVIYLNWIEYCSSRRAKPVDVDKD  891
ref|XP_027243.1  RLCADRNYVDVDPTFNPI-IDEDYDHRLAGISRESFCVIYLRWIEYCSSRRAKPVDVDKD   64
gi|15076843|gb|  RLCADRNYVDVDPTFNPI-IDEDYDHRLAGISRESFCVIYLNWIEYCSSRRAKPVDVDKD 1786
gi|6650377|gb|A  RLCADRNYVDVDPTFNPI-IDEDYDHRLAGISRESFCVIYLSWIEYCSSRRAKPIDVDKD  891
gi|13171105|gb|  RGCSERNYVDFDATFNPN-IDEDYDHRLSGISRDSFCGVYLGWICYCNSRPTKPDSEKD 1195
gi|7290294|gb|A  RRKPDDQRVFIVVGGGPSGAVAVETIRQEGFTGRLIFVCREDYIPYDRVKISKAMNLEIE  191

1810      1820      1830      1840      1850      1860
                 ....|....|....|....|....|....|....|....|....|....|....|....|
NOV3             SSLVTLCYGLCVLGRRALGTASHHMSSNLESFLYGLHALFKGDFRISSIRDEWIFADMEL  951
ref|XP_027243.1  SSLVTLCYGLCVLGRRALGTASHHMSSNLESFLYGLHALFKGDFRISSIRDEWIFADMEL  124
gi|15076843|gb|  SSLVTLCYGLCVLGRRALGTASHHMSSNLESFLYGLHALFKGDFRISSIRDEWIFADMEL 1846
gi|6650377|gb|A  SSLVTLCYGLCVLGRRALGTASHHMSSNLESFLYGLHALFKGDFRISSVRDEWIFADMEL  951
gi|13171105|gb|  SALVLLCFGLCVLGRRALGTAAHQMSSNLESFLYGLHALFKGDFRISSVRDEWIFADMEL 1255
gi|7290294|gb|A  Q---------LRFR-----DEEFYKEYDIELWQGVAAEKLDTAQKELHCSNGYVVKYDKI  237

1870      1880      1890      1900      1910      1920
                 ....|....|....|....|....|....|....|....|....|....|....|....|
NOV3             LRKVVVPGIRMSIK-LHQDHFTSPDEYDDPTVLYEAIVSHEKNLVIAHEGDPAWRSAVLA 1010
ref|XP_027243.1  LRKVVVPGIRMSIK-LHQDHFTSPDEYDDPTVLYEAIVSHEKNLVIAHEGDPAWRSAVLA  183
gi|15076843|gb|  LRKVVVPGIRMSIK-LHQDHFTSPDEYDDPTVLYEAIVSHEKNLVIAHEGDPAWRSAVLA 1905
gi|6650377|gb|A  LRKVVVPGIRMSIK-LHQDHFTSPDEYDDPTVLYEAIVSHEKNLVIAHEGDPAWRSAVLA 1010
gi|13171105|gb|  LRKVVVPGIRMSLK-LHQDHFTSPDEYDDPAVLFEAISTHQONLVIAHEGDPAWRSAVLS 1314
gi|7290294|gb|A  YLATGCSAFRPPIPGVNLENVRTVRELADTKAILASITPESR---------------VVC  282

1930      1940      1950      1960      1970      1980
                 ....|....|....|....|....|....|....|....|....|....|....|....|
NOV3             NSPSLLALRHVMDDGTNEYKIIMLNRRYLSFRVIKVNKECVRGLWAGQQQELVFLRNRNP 1070
ref|XP_027243.1  NSPSLLALRHVMDDGTNEYKIIMLNRRYLSFRVIKVNKECVRGLWAGQQQELVFLRNRNP  243
gi|15076843|gb|  NSPSLLALRHVMDDGTNEYKIIMLNRRYLSFRVIKVNKECVRGLWAGQQQELVFLRNRNP 1965
gi|6650377|gb|A  NSPSLLALRHVMDDGTNEYKIIMLNRRYLSFRVIKVNKECVRGLWAGQQQELVFLRNRNP 1070
gi|13171105|gb|  NAPSLLALRHVEDEGTNEYKIIMLNRRYLSFRVIKVNKECVRGLWAGQQQELVFLRNRNP 1374
gi|7290294|gb|A  LGSSFEALEAAAGLVSKVQSVTVVGRENVPLKAAFGAEIGQPVLQLFEDNKVVMRMESG-  341

1990      2000      2010      2020      2030      2040
                 ....|....|....|....|....|....|....|....|....|....|....|....|
NOV3             ERGSIQNAKQALRNMINSSCDQPIGYPIFVSPLTTSYSDSHQQLKETLGGPISLGNIRNF 1130
ref|XP_027243.1  ERGSIQNAKQALRNMINSSCDQPIGYPIFVSPLTTSYSDSHQQLKETLGGPISLGNIRNF  303
gi|15076843|gb|  ERGSIQNAKQALRNMINSSCDQPIGYPIFVSPLTTSYSDSHEQLKETLGGPISLGNIRNF 2025
gi|6650377|gb|A  ERGSIQNAKQALRNMINSSCDQPIGYPIFVSPLTTSYSDSHDQLKETLGGPISLGNIRNF 1130
gi|13171105|gb|  ERGSIQNAKQALRNMINSSCDQPIGYPIYVSPLTTSYCNSHPQLRHTLGGPISFGNIRNF 1434
gi|7290294|gb|A  -IAEIVGNEDGKVSEVVLVDDTRLPCDLLILGTGSKLNTQFLAKSGVKVNRNGSVDVTDF  400

2050      2060      2070      2080      2090      2100
                 ....|....|....|....|....|....|....|....|....|....|....|....|
NOV3             IVSTWHRLRKGCGAGCNSGGNIEDSDTGGGTSCIGNNATTANNPHSNVTQGSIGNPGQGS 1190
ref|XP_027243.1  IVSTWHRLRKGCGAGCNSGGNIEDSDTGGGTSCIGNNATTANNPHSNVTQGSIGNPGQGS  363
gi|15076843|gb|  IVSTWHRLRKGCGAGCNSGGNIEDSDTGGGTSCIGNNATTANNPHSNVTQGSIGNPGQGS 2085
gi|6650377|gb|A  IVSTWHRLRKGCGAGCNSGGNIEDSDTGGGTSCPGNSAVTSDPHNNVSQGSTGLPGQGA 1190
gi|13171105|gb|  VVSTWHRLRKGCGAGCNSGGNIEDSDAGC------------------------------ 1463
gi|7290294|gb|A  LES--N-VP-----DVYVGGDIANAHIHG-------------------------------  421
```

TABLE 3D-continued

ClustalW Analysis of NOV3

```
                    2110       2120       2130       2140       2150       2160
                ....|....|....|....|....|....|....|....|....|....|....|....|
NOV3            CTGLHPPVTSYPPTLGTSHSSHSVQSGLVRQSPARASVASQSS-YVYSS-RHSSLRMSTT  1248
ref|XP_027243.1 CTGLHPPVTSYPPTLGTSHSSHSVQSGLVRQSPARASVASQSS-YVYSS-RHSSLRMSTT  421
gi|15076843|gb| CTGLHPPVTSYPPTLGTSHSSHSVQSGLVRQSPARASVASQSS-YVYSS-RHSSLRMSTT  2143
gi|6650377|gb|A CSGLHPPTTSYPPTLGTSHSAHSVQSSLVRQSPARASMASQSS-YVYSS-RHSSLRMSTT  1248
gi|13171105|gb| ---------LS--CGTSQSSQSVQSGLVRHSPARASVVSQSSSYRYSSSRHSSLRTSTT  1511
gi|7290294|gb|A ----------------LAHDRVNIGHYQLAQYHGEVAAINMCG-----------------  448

2170       2180       2190       2200       2210       2220
                ....|....|....|....|....|....|....|....|....|....|....|....|
NOV3            GFVPCRRSSTSQISLRNLPSSIQSRLSMVNQMEPSGQSGLACVQHGLPSSSSSSQSIPAC  1308
ref|XP_027243.1 GFVPCRRSSTSQISLRNLPSSIQSRLSMVNQMEPSGQSGLACVQHGLPSSSSSSQSIPAC  481
gi|15076843|gb| GFVPCRRSSTSQISLRNLPSSIQSRLSMVNQMEPSGQSGLACVQHGLPSSSSSSQSIPAC  2203
gi|6650377|gb|A GFVPCRRSSTSQISLRNLPSSIQSRLSMVNQMEASQGGMGCVQHGLPSSSSSSQSIPAC  1308
gi|13171105|gb| GLEPCRRSSTSQESLRTLPTSEQERLGST--SDEAC----------PSSSLSSHSIPPC  1558
gi|7290294|gb|A --G--------VKKLEAVPFFFTLIFGKG--IRYAG--------HG---SYKDVIIDGSM  485

2230       2240       2250       2260       2270       2280
                ....|....|....|....|....|....|....|....|....|....|....|....|
NOV3            KHHTLVGFIATEGGQSSATDAQ-----PGNTLSPANNSHS--RKAEVIYRVQIVDPSQIL  1361
ref|XP_027243.1 KHHTLVGFIATEGGQSSATDAQ-----PGNTLSPANNSHS--RKAEVIYRVQIVDPSQIL  534
gi|15076843|gb| KHHTLVGFIATEGGQSSATDAQ-----PGNTLSPANNSHS--RKAEVIYRVQIVDPSQIL  2256
gi|6650377|gb|A KHHTLVAFIGAEGGQCSATEAQ-----PGNTLSPANNSHA--RKGEVIYRVQIVDLSQIL  1361
gi|13171105|gb| KRHTLVGLLGNDGLCSTVTDPLSQHHHPHHHPQQHNPTHATVRRDDISYRVQIVDVGQML  1618
gi|7290294|gb|A EDFKFVAYFINEADTVIAVASC-----------G----------RDPIVAQFAELISQGKCL  526

2290       2300       2310       2320       2330       2340
                ....|....|....|....|....|....|....|....|....|....|....|....|
NOV3            EGINLSKRKELQWPDEGIRLKAGRNSWKDWSPQEGMEGHVIHRWVPCSRDPGTRSHIDKA  1421
ref|XP_027243.1 EGINLSKRKELQWPDEGIRLKAGRNSWKDWSPQEGMEGHVIHRWVPCSRDPGTRSHIDKA  594
gi|15076843|gb| EGINLSKRKELQWPDEGIRLKAGRNSWKDWSPQEGMEGHVIHRWVPCSRDPGTRSHIDKA  2316
gi|6650377|gb|A EGINVSKRKELHWPDEGIRLKAGRNSWKDWSPQEGMEGHVVHRWVPCSRDPSTRSHIDNT  1421
gi|13171105|gb| ENINLSKRKELQWPDDAMRHKAGRTCWRDWSPLEGMEGHVIHRWVPCSRDPGSRSHIDKT  1678
gi|7290294|gb|A G------RGQIEDP-------A---IREDWEKKLGQP--------LPQVR----------  552

2350       2360
                ....|....|....|....|
NOV3            VLLVQIDDKYVTVIETGVLELGAEV  1446
ref|XP_027243.1 VLLVQIDDKYVTVIETGVLELGAEV  619
gi|15076843|gb| VLLVQIDDKYVTVIETGVLELGAEV  2341
gi|6650377|gb|A VLLVQIDDKYVTIIETGVLELGAEV  1446
gi|13171105|gb| ILLVQVEDKIVPIIETGVIELGAEV  1703
gi|7290294|gb|A ------------------------  552
```

Pecanex gene was originally discovered in *Drosophila*, encoding a large, membrane-spanning protein. The mouse homolog was recently reported. In the absence of maternal expression of the pecanex gene, the embryo develops severe hyperneuralization similar to that characteristic of Notch mutant embryos. Early gastrula embryos, lacking both maternally and zygotically expressed activity of the neurogenic pecanex locus, are shown to contain a greater than wild-type number of stably determined neural precursor cells which can differentiate into neurons in culture. Therefore it is anticipated that this novel human pecanex will be involved in neuronal differentiation, maintenance of neuronal precursors and neurological diseases.

The disclosed NOV3 nucleic acid of the invention encoding a Human homolog of the *Drosophila* pecanex protein includes the nucleic acid whose sequence is provided in Table 3A or a fragment thereof. The invention also includes a mutant or variant nucleic acid any of whose bases may be changed from the corresponding base shown in Table 3A while still encoding a protein that maintains its Human homolog of the *Drosophila* pecanex activities and physiological functions, or a fragment of such a nucleic acid. The invention further includes nucleic acids whose sequences are complementary to those just described, including nucleic acid fragments that are complementary to any of the nucleic acids just described. The invention additionally includes nucleic acids or nucleic acid fragments, or complements thereto, whose structures include chemical modifications. Such modifications include, by way of nonlimiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject. In the mutant or variant nucleic acids, and their complements, up to about 1 percent of the bases may be so changed.

The disclosed NOV3 protein of the invention includes the Human homolog of the *Drosophila* pecanex protein whose sequence is provided in Table 3B. The invention also includes a mutant or variant protein any of whose residues may be changed from the corresponding residue shown in Table 3B while still encoding a protein that maintains its Human homolog of the *Drosophila* pecanex activities and physiological functions, or a functional fragment thereof. In the mutant or variant protein, up to about 7 percent of the residues may be so changed.

The NOV3 nucleic acids and proteins of the invention are useful in potential therapeutic applications implicated in cancer, trauma, regeneration (in vitro and in vivo), viral/bacterial/parasitic infections, cardiomyopathy, atherosclerosis, hypertension, congenital heart defects, aortic stenosis, atrial septal defect (ASD), atrioventricular (A-V) canal defect, ductus arteriosus, pulmonary stenosis, subaortic stenosis, ventricular septal defect (VSD), valve diseases, tuberous sclerosis, multiple sclerosis, scleroderma, obesity, endometriosis, fertility, hypercoagulation, autoimmume disease, allergies, immunodeficiencies, transplantation, hemophilia, idiopathic thrombocytopenic purpura, graft versus host disease, Von Hippel-Lindau (VHL) syndrome, Alzheimer's disease, stroke, hypercalceimia, Parkinson's disease, Huntington's disease, cerebral palsy, epilepsy, ataxia-telangiectasia, leukodystrophies, behavioral disorders, addiction, anxiety, pain, neuroprotection, systemic lupus erythematosus, asthma, emphysema, ARDS, laryngitis, psoriasis, actinic keratosis, acne, hair growth/loss, alopecia, pigmentation disorders, endocrine disorders, diabetes, renal artery stenosis, interstitial nephritis, glomerulonephritis, polycystic kidney disease, systemic lupus erythematosus, renal tubular acidosis, IgA nephropathy, Lesch-Nyhan syndrome, and a variety of kidney diseases and/or other pathologies and disorders.

NOV3 nucleic acids and polypeptides are further useful in the generation of antibodies that bind immunospecifically to the novel substances of the invention for use in therapeutic or diagnostic methods. These antibodies may be generated according to methods known in the art, using prediction from hydrophobicity charts, as described in the "Anti-NOVX Antibodies" section below. The disclosed NOV3 protein has multiple hydrophilic regions, each of which can be used as an immunogen. In one embodiment, a contemplated NOV3 epitope is from about amino acids 20 to 50. In another embodiment, a NOV3 epitope is from about amino acids 180 to 200. In additional embodiments, NOV3 epitopes are from about amino acids 360 to 400, from about 450 to 500, from about amino acids 600 to 680, from about amino acids 720 to 780, from about amino acids 800 to 860, from about amino acids 950 to 1000, from about amino acids 1050 to 1100, from about amino acids 1150 to 1320, and from about amino acids 1350 to 1420. These novel proteins can be used in assay systems for functional analysis of various human disorders, which are useful in understanding of pathology of the disease and development of new drug targets for various disorders.

NOV4

A disclosed NOV4 nucleic acid of 1500 nucleotides (also referred to as SC140515441_A) encoding a novel Aurora-related kinase 1-like protein is shown in Table 4A. An open reading frame was identified beginning with a ATG initiation codon at nucleotides 182–184 and ending with a TAG codon at nucleotides 1391–1393. The start and stop codons are in bold letters, and the 5' and 3' untranslated regions are underlined.

TABLE 4A

NOV4 Nucleotide Sequence (SEQ ID NO:13)

TCATCTTAAATTTTTTTAGCTGATATAGTTGTAATTTCTTAACCTAGCTCATCTCTAGAGGATATGTAAAA

ACATAAAACACCTCAATTACTTGTGAATTATAGAGGTGTATCAGTTGGTTTAAAAGTGCTTTTATTGGGCT

GAGCTCTTGGAAGACTCAGGTCCTTGGGTCATAGGCATCATGGACCAATCTGAAGAAAACTGCATTTCAGG

GCCTGTTGAGGCTAAAACTCCAGTTGGAGGTCCAGAACATGTTCTCGTGACTCAGCAATTTCCTTGTCAGA

ATCCATTACCTGCAAATAGTGGCCAGGCTCAGTGGGTCTTGTGTCCTTCAAATTCTTCGCAGCGTGTTCCT

TTGCAAGCACAAAAGCTTGTCTCCAGTCACAAGCCAGTTCAGAATCAGAAGCAGAAGCAATTGCAGGCAAC

CAGTGTACCTCATCCTGCCTCCAGGCCACTGAATAACACCCAAAACAGCAAGCAGTCCCCGCTGTCGGCAC

CTGAAAATAATCCTGAGGAGGAACTGGCATCAAAACAGAAAAATGAAGAATCAAAAAAGAGGCAATGGGCT

TTGGAAGACCTTGAAATTGGTCGCCCTCCGGGTAAAGGAAAGTTTGGTAATGTTTATTTGGCAAGAGAAAA

ACAAAGCAAGTTTATTCTGGCTCTTAGGGTGTTATTTAAAGCTCAGCTGGAGAAAGCAGGAGTGGAGCATC

AACTCAGAAGAGAAGTAGAAATACAGTCCCACCTCCAACATCCTAATATAATCAGACTGTATGGTTATTTC

CATGATGCCACCAGAGTCTACCTAATTCTGGAATATACACCACTTGAAACAGTCAATACAGAACTTCAGAA

ACTTTCAAAGTTTGATGAGCAGAGAACTGCTACTTATATCACAGAATTGGCAAGTGCCCTGTCTTACTGTC

ATTCAAAAACAGTTATTCATAGAGACATTAAGCCAGAGAACTTACTTCTTGGATCAGCTGGAGAGCTTGAA

ATTGCAAATTTTGGGTGGTCAGAACATGCTCCATCTTCCAGGAGGACCACTCTCTGTGGCACCCTGGACTA

CCTGCCCCCCGAAATGATTGAAGGTCGGATGCATGATGAGAAGGTGGATCTCTGGAGCCTTGGAGTTCTTT

GCTGTGAATTTTTAGTTGGGAAGCCTCCTTTTGAGGCAAATACATACCAAGAGACCTACAAAAGAATATCA

CGGGTTGAGTTCACATTCCCTGACTTTGTAACAGAGGGAGCCAGGGACCTCATTTCAAGACTGTTGAAGCA

TGTTCCCAGCCAGAGGCCAATGCTCAGAGAAGTACTTGAATACCCCTGGATCACAGCAAATTCATCAAAAC

TABLE 4A-continued

NOV4 Nucleotide Sequence

CATCAAATTGCCAAAACAAAGAATCAACTAGCAAGTATTCTTAGGAATCGTGCAGGGGGAGAAATCCTTGA

GCCAGGGCTGCTGTATAACCTCTCAGGAACATGCTACCAAAATTTATTTTACCATTGACTGCTGCCCTCAA

TCTAGAACA

The disclosed NOV4 nucleic acid sequence maps to chromosome 1 and has 1152 of 1212 bases (95%) identical to a gb:GENBANK-ID:AF008551|acc:AF008551 mRNA from *Homo sapiens* (*Homo sapiens* aurora-related kinase 1 (ARK1) mRNA, complete cds (E=1.8e$^{-243}$).

A disclosed NOV4 protein (SEQ ID NO:14) encoded by SEQ ID NO:13 has 403 amino acid residues, and is presented using the one-letter code in Table 4B. Signal P, Psort and/or Hydropathy results predict that NOV4 does not have a signal peptide, and is likely to be localized to the cytoplasm with a certainty of 0.4500. In other embodiments NOV4 is also likely to be localized microbody (peroxisome) with a certainty of 0.3000, to the mitochondrial membrane space with a certainty of 0.1000, or to the lysosome(lumen) with a certainty of 0.1000.

TABLE 4B

Encoded NOV4 protein sequence.

(SEQ ID NO:14)
MDQSEENCISGPVEAKTPVGGPEHVLVTQQFPCQNPLPANSGQAQWVLCPSNSSQRVPLQAQKLVSSHKPV

QNQKQKQLQATSVPHPASRPLNNTQNSKQSPLSAPENNPEEELASKQKNEESKKRQWALEDLEIGRPPGKG

KFGNVYLAREKQSKFILALRVLFKAQLEKAGVEHQLRREVEIQSHLQHPNIIRLYGYFHDATRVYLILEYT

PLETVNTELQKLSKFDEQRTATYITELASALSYCHSKTVIHRDIKPENLLLGSAGELEIANFGWSEHAPSS

RRTTLCGTLDYLPPEMIEGRMHDEKVDLWSLGVLCCEFLVGKPPFEANTYQETYKRISRVEFTFPDFVTEG

ARDLISRLLKHVPSQRPMLREVLEYPWITANSSKPSNCQNKESTSKYS

The disclosed NOV4 amino acid has 69 of 403 amino acid residues (91%) identical to, and 381 of 403 amino acid residues (94%) similar to, the 403 amino acid residue ptnr:SPTREMBL-ACC:O60445 protein from *Homo sapiens* (Human) (Aurora-Related Kinase 1 (E=1.7e$^{-198}$).

NOV4 is expressed in at least Adrenal Gland/Suprarenal gland, Amygdala, Bone Marrow, Brain, Cervix, Colon, Coronary Artery, Epidermis, Heart, Kidney, Liver, Lung, Lymphoid tissue, Mammary gland/Breast, Ovary, Peripheral Blood, Placenta, Prostate, Testis, Thalamus, Tonsils, Uterus. This information was derived by determining the tissue sources of the sequences that were included in the invention.

In addition, NOV4 is predicted to be expressed in colon because of the expression pattern of (GENBANK-ID: gb:GENBANK-ID:AF008551|acc:AF008551) a closely related aurora-related kinase 1 (ARK1) mRNA, complete cds homolog in species *Homo sapiens*.

NOV4 also has homology to the amino acid sequences shown in the BLASTP data listed in Table 4C.

TABLE 4C

BLAST results for NOV4

| Gene Index/ Identifier | Protein/Organism | Length (aa) | Identity (%) | Positives (%) | Expect |
|---|---|---|---|---|---|
| gi|12654873|gb|AAH0 1280.1|AAH01280 (BC001280) | serine/threo nine kinase 15 [*Homo sapiens*] | 403 | 370/403 (91%) | 381/403 (93%) | 0.0 |

TABLE 4C-continued

BLAST results for NOV4

| Gene Index/ Identifier | Protein/Organism | Length (aa) | Identity (%) | Positives (%) | Expect |
|---|---|---|---|---|---|
| gi\|13653970\|ref\|XP_009546.3\| (XM_009546) | serine/threonine kinase 15 [*Homo sapiens*] | 403 | 369/403 (91%) | 381/403 (93%) | 0.0 |
| gi\|4507275\|ref\|NP_003591.1\| (NM_003600) | serine/threonine kinase 15; Serine/threonine protein kinase 15 [*Homo sapiens*] | 403 | 369/403 (91%) | 380/403 (93%) | 0.0 |
| gi\|7446411\|pir\|\|JC5974 | aurora-related kinase 1 (EC 2.7.-.-) - human | 403 | 367/403 (91%) | 379/403 (93%) | 0.0 |
| gi\|4507279\|ref\|NP_003149.1\| (NM_003158) | serine/threonine kinase 6; Serine/threonine protein kinase-6; serine/threonine kinase 6 (aurora/IPL1-like) [*Homo sapiens*] | 402 | 342/403 (84%) | 360/403 (88%) | 0.0 |

The homology of these sequences is shown graphically in the ClustalW analysis shown in Table 4D.

TABLE 4D

ClustalW Analysis of NOV4

1) NOV4 (SEQ ID NO:14)
2) gi|12654873|gb|AAH01280.1|AAH01280 (BC001280) serine/threonine kinase 15 [Homo sapiens] (SEQ ID NO:47)
3) gi|13653970|ref|XP_009546.3| (XM_009546) serine/threonine kinase 15 [Homo sapiens] (SEQ ID NO:48)
4) gi|4507275|ref|NP_003591.1| (NM_003600) serine/threonine kinase 15; Serine/threonine protein kinase 15 [Homo sapiens] (SEQ ID NO:49)
5) gi|7446411|pir||JC5974 aurora-related kinase 1 (EC 2.7.-.-) - human (SEQ ID NO:50)
6) gi|4507279|ref|NP_003149.1| (NM_003158) serine/threonine kinase 6; Serine/threonine protein kinase-6; serine/threonine kinase 6 (aurora/IPL1-like) [Homo sapiens] (SEQ ID NO:51)

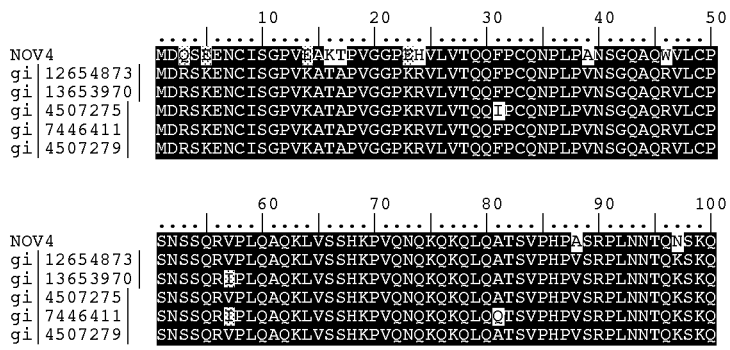

TABLE 4D-continued

ClustalW Analysis of NOV4

```
              110        120        130        140        150
              ....|....|....|....|....|....|....|....|....|....|
NOV4          SPLSAPENNPEEELASKQKNEESKKRQWALEDLEIGRPPGKGKFGNVYLA
gi|12654873|  PLPSAPENNPEEELASKQKNEESKKRQWALEDFEIGRPLGKGKFGNVYLA
gi|13653970|  PLPSAPENNPEEELASKQKNEESKKRQWALEDFEIGRPLGKGKFGNVYLA
gi|4507275|   PLPSAPENNPEEELASKQKNEESKKRQWALEDFEIGRPLGKGKFGNVYLA
gi|7446411|   PLPSAPENNPEEELASKQKNEESKKRQWALEDFEIGRPLGKGKFGNVYLA
gi|4507279|   PLPSHLKIILRRNWHQNRK-MKNQKEAVALEDFEIGRPLGKGKFGNVYLA 160        170        180        190        200
              ....|....|....|....|....|....|....|....|....|....|
NOV4          REKQSKFILALRVLFKAQLEKAGVEHQLRREVEIQSHLCHPNIRRLYGYF
gi|12654873|  REKQSKFILALKVLFKAQLEKAGVEHQLRREVEIQSHLRHPNILRLYGYF
gi|13653970|  REKQSKFILALKVLFKAQLEKAGVEHQLRREVEIQSHLRHPNILRLYGYF
gi|4507275|   REKQSKFILALKVLFKAQLEKAGVEHQLRREVEIQSHLRHPNILRLYGYF
gi|7446411|   REKQSKGILALKVLFKAQLEKAGVEHQLRREVEIQSHLRHPNILRLYGYF
gi|4507279|   REKQSKFILALKVLFKAQLEKAGVEHQLRREVEIQSHLRHPNILRLYGYF 210        220        230        240        250
              ....|....|....|....|....|....|....|....|....|....|
NOV4          HDATRVYLILEYTPLETVNTELQKLSKFDEQRTATYITELASALSYCHSK
gi|12654873|  HDATRVYLILEYAPLGTVYRELQKLSKFDEQRTATYITELANALSYCHSK
gi|13653970|  HDATRVYLILEYAPLGTVYRELQKLSKFDEQRTATYITELANALSYCHSK
gi|4507275|   HDATRVYLILEYAPLGTVYRELQKLSKFDEQRTATYITELANALSYCHSK
gi|7446411|   HDATRVYLILEYAPLGTVYRELQKLSKFDEQRTATYITELANALSYCHSK
gi|4507279|   HDATRVYLILEYAPLGTVYRELQKLSKFDEQRTANLYNRIANALSYCHSK 260        270        280        290        300
              ....|....|....|....|....|....|....|....|....|....|
NOV4          TVIHRDIKPENLLLGSAGELEIANFGWSEHAPSSRRTTLCGTLDYLPPEM
gi|12654873|  RVIHRDIKPENLLLGSAGELKIADFGWSVHAPSSRRTTLCGTLDYLPPEM
gi|13653970|  RVIHRDIKPENLLLGSAGELKIADFGWSVHAPSSRRTTLCGTLDYLPPEM
gi|4507275|   RVIHRDIKPENLLLGSAGELKIADFGWSVHAPSSRRTTLCGTLDYLPPEM
gi|7446411|   RVIHRDIKPENLLLGSAGELKIADFGWSVHAPSSRRTTLCGTLDYLPPEM
gi|4507279|   RVIHRDIKPENLLLGSAGELKIADFGWSVHAPSSRRTTLCGTLDYLPPEM 310        320        330        340        350
              ....|....|....|....|....|....|....|....|....|....|
NOV4          IEGRMHDEKVDLWSLGVLCCEFLVGKPPFEANTYQETYKRISRVEFTFPD
gi|12654873|  IEGRMHDEKVDLWSLGVLCYEFLVGKPPFEANTYQETYKRISRVEFTFPD
gi|13653970|  IEGRMHDEKVDLWSLGVLCYEFLVGKPPFEANTYQETYKRISRVEFTFPD
gi|4507275|   IEGRMHDEKVDLWSLGVLCYEFLVGKPPFEANTYQETYKRISRVEFTFPD
gi|7446411|   IEGRMHDEKVDLWSLGVLCYEFLVGKPPFEANTYQETYKRISRVEFTFPD
gi|4507279|   IEGRMHDEKVDLWSLGVLCYEFLVGKPPFEANTYQETYKRISRVEFTFPD 360        370        380        390        400
              ....|....|....|....|....|....|....|....|....|....|
NOV4          FVTEGAEDLISRLLKHVPSQRPMLREVLEMPWITANSSKPSNCQNKESTS
gi|12654873|  FVTEGAEDLISRLLKHNPSQRPMLREVLEHPWITANSSKPSNCQNKESAS
gi|13653970|  FVTEGAEDLISRLLKHNPSQRPMLREVLEHPWITANSSKPSNCQNKESAS
gi|4507275|   FVTEGAEDLISRLLKHNPSQRPMLREVLEHPWITANSSKPSNCQNKESAS
gi|7446411|   FVTEGAEDLISRLLKHNPSQRPMLREVLEHPWITANSSKPSNCQNKESAS
gi|4507279|   FVTEGAEDLISRLLKHNPSQRPMLREVLEHPWITANSSKPSNCQNKESAS

NOV4          KYS
gi|12654873|  KQS
gi|13653970|  KQS
gi|4507275|   KQS
gi|7446411|   KQS
gi|4507279|   KQS
```

Tables 4E–G lists the domain description from DOMAIN analysis results against NOV4. This indicates that the NOV4 sequence has properties similar to those of other proteins known to contain this domain.

TABLE 4E

Domain Analysis of NOV4 gnl|Smart|smart00220, S_TKc, Serine/Threonine protein kinases, catalytic domain; Phosphotransferases, Serine or threonine-specific kinase subfamily. (SEQ ID NO:98)
CD-Length = 256 residues, 99.6% aligned
Score = 256 bits (653), Expect = 2e-69

TABLE 4E-continued

Domain Analysis of NOV4

```
NOV 3:  134 EIGRPPGKGKFGNVYLAREKQSKFILALRVLFKAQLEKAGVEHQLRREVEIQSHLQHPNI 193
            |+   |||  ||  |||||+|++  ++|++|+  |  +|+|    ++ ||++|    | ||||
Sbjct:    2 ELLEVLGKGAFGKVYLARDKKTGKLVAIKVIKKEKLKK-KKRERILREIKILKKLDRPNI  60

NOV 3:  194 IRLYGYFHDATRVYLILEYTPLETVNTELQKLSKFDEQRTATYITELASALSYCHSKTVI 253
            ++||   |   |  ++||++||      +  |+| +   |     ++ |||  |  ||+ +|
Sbjct:   61 VKLYDVFEDDDKLYLVMEYCEGGDLFDLLKKRGRLSEDEARFYARQILSALEYLHSQGII 120

NOV 3:  254 HRDIKPENLLLGSAGELEIANFGWS--EHAPSSRRTTLCGTLDYLPPEMIEGRMHDEKVD 311
            |||+||||+||   |   +++|+||    +      + ||   || +|+ ||++ |+ + ||
Sbjct:  121 HRDLKPENILLDSDGHVKLADFGLAKQLDSGGTLLTTFVGTPEYMAPEVLLGKGYGKAVD 180

NOV 3:  312 LWSLGVLCCEFLVGKPPFEA-NTYQETYKRISRVEFTFPDF---VTEGARDLISRLLKHV 367
            +|||||+  |   |||||      +    +|+|  +    ||     ++  |+|||  +|| +|
Sbjct:  181 IWSLGVILYELLTGKPPFPGDDQLLALFKKIGKPPPPFPPPEWKISPEAKDLIKKLLVKD 240

NOV 3:  368 PSQRPMLREVLEYPWI 383
              | +|    |  ||+|+
Sbjct:  241 PEKRLTAEEALEHPFF 256
```

TABLE 4F

Domain Analysis of NOV4 gnl|Pfam|pfam00069, pkinase, Protein kinase domain (SEQ ID NO:99)
CD-Length = 256 residues, 100.0% aligned
Score = 221 bits (564), Expect = 5e-59

```
NOV 3:  133 LEIGRPPGKGKFGNVYLAREKQSKFILALRVLFKAQLEKAGVEHQLRREVEIQSHLQHPN 192
              |+    |   ||   ||    +  +  +|+|+|  |   | + + ||++|     |||
Sbjct:    1 YELGEKLGSGAFGKVYKGKHKDTGEIVAIKILKKRSLSE--KKKRFLREIQILRRLSHPN  58

NOV 3:  193 IIRLYGYFHDATRVYLILEYTPLETVNTEL-QKLSKFDEQRTATYITELASALSYCHSKT 251
            |+||  |   +  +||++||      +  |+    |+      ++    |   ||+
Sbjct:   59 IVRLLGVFEEDDHLYLVMEYMEGGDLFDYLRRNGLLLSEKEAKKIALQILRGLEYLHSRG 118

NOV 3:  252 VIHRDIKPENLLLGSAGELEIANFGWS---EHAPSSRRTTLCGTLDYLPPEMIEGRMHDE 308
            ++|||+||||+|    |  ++|+||  +     |   +  ||    ||  +|+  ||++|||   +
Sbjct:  119 IVHRDLKPENILLDENGTVKIADFGLARKLESSSYEKLTTFVGTPEYMAPEVLEGRGYSS 178

NOV 3:  309 KVDLWSLGVLCCEFLVGKPPFEANTYQETYKRI---SRVEFTFPDFVTEGARDLISRLLK 365
            |||+||||+|  |  | ||   ||         |   ||  |+    |  +|  +|||  + |
Sbjct:  179 KVDVWSLGVILYELLTGKLPFPGIDPLEELFRIKERPRLRLPPPNCSEELKDLIKKCLN  238

NOV 3:  366 HVPSQRPMLREVLEYPWI 383
               | +||   +|+|  +||
Sbjct:  239 KDPEKRPTAKEILNHPWF 256
```

TABLE 4G

Domain Analysis of NOV4 gnl|Smart|smart00219, TyrKc, Tyrosine kinase, catalytic domain;
Phosphotransferases. Tyrosine-specific kinase subfamily
(SEQ ID NO:100)
CD-Length = 258 residues, 99.6% aligned
Score = 127 bits (318), Expect = 2e-30

```
NOV 3:  133 LEIGRPPGKGKFGNVYLAREKQSKFILALRVLFKAQLEKAGVEHQ--LRREVSIQSHLQH 190
              | +|+  +|  ||  ||  ||    |    +  +|   |    ||  +    ||  +   ||
Sbjct:    1 LTLGKKLGEGAFGEVYKGTLKGKGGVE-VEVAVKTLKEDASEQQIEEFLREARLMRKLDH  59

NOV 3:  191 PNIIRLYGYFHDATRVYLILEYTPLETVNTELQKLSK--FDEQRTATYITELASALSYCH 248
            |||++|  |    +    +  +++||    +    +|+|     ++   ++  + |
Sbjct:   60 PNIVKLLGVCTEEEPLMIVMEYMEGGDLLDYLRKNRPKELSLSDLLSFALQIARGMEYLE 119

NOV 3:  249 SKTVIHRDIKPENLLLGSAGELEIANFGWSEHAPSSRRTTLCGTLD----YLPPEMIEGR 304
            ||   +|||+   |+|   ++|+|+||+   +                     ++  ||  ++
Sbjct:  120 SKNFVHRDLAARNCLVGENKTVKIADFGLARDLYDDDYYRKKKSPRLPIRWMAPESLKDG 179

NOV 3:  305 MHDEKVDLWSLGVLCCE-FLVGKPPFEANTYQETYKRISRVEF-TFPDFVTEGARDLISR 362
```

TABLE 4G-continued

Domain Analysis of NOV4

```
              |  |+||  |||   |  | +|+  |+    + +|   + + +          |    +   ||+ +
Sbjct:   180  KFTSKSDVWSFGVLLWEIFTLGESPYPGMSNEEVLEYLKKGYRLPQPPNCPDEIYDLMLQ  239

NOV 3:   363  LLKHVPSQRPMLREVLEY  380
                  |  ||    |++|
Sbjct:   240  CWAEDPEDRPTFSELVER  257
```

Amplification of chromosome 20q DNA has been reported in a variety of cancers. DNA amplification on 20q13 has also been correlated with poor prognosis among axillary node-negative breast tumor cases. Sen et al. (1997) cloned a partial cDNA encoding STK15 (also known as BTAK and aurora2) from this amplicon and found that it is amplified and overexpressed in 3 human breast cancer cell lines. STK15 encodes a centrosome-associated kinase. Zhou et al. (1998) found that STK15 is involved in the induction of centrosome duplication-distribution abnormalities and aneuploidy in mammalian cells. Centrosomes appear to maintain genomic stability through the establishment of bipolar spindles during cell division, ensuring equal segregation of replicated chromosomes to 2 daughter cells. Deregulated duplication and distribution of centrosomes are implicated in chromosome segregation abnormalities, leading to aneuploidy seen in many cancer cell types. Zhou et al. (1998) found amplification of STK15 in approximately 12% of primary breast tumors, as well as in breast, ovarian, colon, prostate, neuroblastoma, and cervical cancer cell lines. Additionally, high expression of STK15 mRNA was detected in tumor cell lines without evidence of gene amplification. Ectopic expression of STK15 in mouse NIH 3T3 cells led to the appearance of abnormal centrosome number (amplification) and transformation in vitro. Finally, overexpression of STK15 in near-diploid human breast epithelial cells revealed similar centrosome abnormality, as well as induction of aneuploidy. These findings suggested that STK15 is a critical kinase-encoding gene, whose overexpression leads to centrosome amplification, chromosomal instability, and transformation in mammalian cells. Zhou et al. (1998) found that the open reading frame of the full-length STK15 cDNA sequence encodes a 403-amino acid protein with a molecular mass of approximately 46 kD. STK6 (602687), also referred to as AIK, is highly homologous to STK15. The Drosophila 'aurora' and S. cerevisiae Ip11 STKs are involved in mitotic events such as centrosome separation and chromosome segregation. Using a degenerate primer-based PCR method to screen for novel STKs, Shindo et al. (1998) isolated mouse and human cDNAs encoding STK15, which they termed ARK1 (aurora-related kinase-1). Cell cycle and Northern blot analyses showed that peak expression of STK15 occurs during the G2/M phase and then decreases. By interspecific backcross mapping, Shindo et al. (1998) mapped the mouse Stk15 gene to the distal region of chromosome 2 in a region showing homology of synteny with human 20q The disclosed NOV4 nucleic acid of the invention encoding a Aurora-related kinase 1-like protein includes the nucleic acid whose sequence is provided in Table 4A or a fragment thereof. The invention also includes a mutant or variant nucleic acid any of whose bases may be changed from the corresponding base shown in Table 4A while still encoding a protein that maintains its Aurora-related kinase 1-like activities and physiological functions, or a fragment of such a nucleic acid. The invention further includes nucleic acids whose sequences are complementary to those just described, including nucleic acid fragments that are complementary to any of the nucleic acids just described. The invention additionally includes nucleic acids or nucleic acid fragments, or complements thereto, whose structures include chemical modifications. Such modifications include, by way of nonlimiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject. In the mutant or variant nucleic acids, and their complements, up to about 5 percent of the bases may be so changed.

The disclosed NOV4 protein of the invention includes the Aurora-related kinase 1-like protein whose sequence is provided in Table 4B. The invention also includes a mutant or variant protein any of whose residues may be changed from the corresponding residue shown in Table 4B while still encoding a protein that maintains its Aurora-related kinase 1-like activities and physiological functions, or a functional fragment thereof. In the mutant or variant protein, up to about 9 percent of the residues may be so changed.

The protein similarity information, expression pattern, and map location for the Aurora-related kinase 1-like protein and nucleic acid (NOV4) disclosed herein suggest that NOV4 may have important structural and/or physiological functions characteristic of the citron kinase-like family. Therefore, the NOV4 nucleic acids and proteins of the invention are useful in potential diagnostic and therapeutic applications. These include serving as a specific or selective nucleic acid or protein diagnostic and/or prognostic marker, wherein the presence or amount of the nucleic acid or the protein are to be assessed, as well as potential therapeutic applications such as the following: (i) a protein therapeutic, (ii) a small molecule drug target, (iii) an antibody target (therapeutic, diagnostic, drug targeting/cytotoxic antibody), (iv) a nucleic acid useful in gene therapy (gene delivery/gene ablation), and (v) a composition promoting tissue regeneration in vitro and in vivo.

The NOV4 nucleic acids and proteins of the invention are useful in potential diagnostic and therapeutic applications implicated in various diseases and disorders described below. For example, the compositions of the present invention will have efficacy for treatment of patients suffering from breast, ovarian, colon, prostate, neuroblastoma, and cervical cancer, Cardiomyopathy, Atherosclerosis, Hypertension, Congenital heart defects, Aortic stenosis, Atrial septal defect (ASD), Atrioventricular (A-V) canal defect, Ductus arteriosus, Pulmonary stenosis, Subaortic stenosis, Ventricular septal defect (VSD), valve diseases, Tuberous sclerosis, Scleroderma, Obesity, Transplantation, Diabetes, Von Hippel-Lindau (VHL) syndrome, Pancreatitis, Alzheimer's disease, Stroke, hypercalceimia, Parkinson's disease, Huntington's disease, Cerebral palsy, Epilepsy, Lesch-Nyhan syndrome, Multiple sclerosis, Ataxia-telangiectasia, Leukodystrophies, Behavioral disorders, Addiction, Anxiety, Pain, and Neuroprotection and/or other pathologies. The NOV4 nucleic acid, or fragments thereof, may further be useful in diagnostic applications, wherein the presence or amount of the nucleic acid or the protein are to be assessed.

NOV4 nucleic acids and polypeptides are further useful in the generation of antibodies that bind immunospecifically to the novel substances of the invention for use in therapeutic or diagnostic methods. These antibodies may be generated according to methods known in the art, using prediction from hydrophobicity charts, as described in the "Anti-NOVX Antibodies" section below. For example the disclosed NOV4 protein have multiple hydrophilic regions, each of which can be used as an immunogen. In one embodiment, contemplated NOV4 epitope is from about amino acids 1 to 10. In another embodiment, a NOV4 epitope is from about amino acids 15 to 160. In additional embodiments, NOV4 epitopes are from about amino acids 175 to 210, from about amino acids 220 to 240, from about amino acids 250 to 270, from about amino acids 280 to 320, from about amino acids 340 to 375, and from about amino acids 380 to 400. This novel protein also has value in development of powerful assay system for functional analysis of various human disorders, which will help in understanding of pathology of the disease and development of new drug targets for various disorders.

NOV5

A disclosed NOV5 nucleic acid of 1500 nucleotides (designated CuraGen Acc. No. SC44326718_A) encoding a novel 26S protease regulatory subunit 4-like protein is shown in Table 5A. An open reading frame was identified beginning with an ATG initiation codon at nucleotides 101–103 and ending with a TAG codon at nucleotides 1427–1429. A putative untranslated region downstream from the termination codon is underlined in Table 5A, and the start and stop codons are in bold letters.

TABLE 5A

NOV5 Nucleotide Sequence (SEQ ID NO:15)
<u>GTATCCCCAAGAGAAAATACGCATCAAAAATTAGGAACTTAGAAATGATAGTTGAGGTGGAGGAACTTCC</u>

<u>AGCAGTGGCAGCTCAAGTGGCCAAGACAAG</u>ATGGGTCAAAGTCAGGGTGATGGTCATGGTCCTAGACGTG

GCAAGAAGGATGAAAAGGACAAGAAAAATAAGTACGAACCTCTTGTACCAACTAGAGTGGCGGAAAAAGA

AGAAAAAACAAAGGGACAAGATGTTGCCAGTAAACTGCCACTGGTGACACTTCACACTCAGTGTCGGTTA

AAATTACTGAAGTTAGAGAGAATTAAAGACTACCTTCTCATGGTGGAAGAATTCATTAGAAATCAGGAAC

AAATAAAACTATTAGAAGAAAAGCAAGAGGAGGGAAGATCAAAAGTGGATGATCTGAGGGGGACCCCAAT

GTCAGTAGGAAACTTGGAAGAGATCATCGATGACAATCATGCCATTGTGTCTACATCTGTGGGCTCAGAA

CACTATGACAGCATTATTTCATTTGTAGAGAAGGATCTGCTGGAACCTGGCTGCTCGATTCTGCTCAGAC

ACAAGGTACATGCGGTGATAGGGGTGCTGATGGATGATACGGGTCCCCTGGTCACAATGATGAAGGTGGA

GAAGGCCCCCCAGGAGACCTATGTCAATACTGGGGGGTTGGACAACCAAATTCAGGAAATTAAGGAATCT

ATGGAGCTTCCTCTCCCCCATCCTGAATATTATGAAGAGATGGGTACAAAGCCTCCTAAAGGGGTCATTC

TCTGTGGTCCACCTGGCACAGGTAAAACCTTGTTAGCCAAAGCAGTAGCAAACCAAACCTCAGCCACTTT

CTTGAGAGTGGTTGGCTCTGAACTTATTCAGAAGTACCTAGGTGATGGGCCCAAACTCGTACGGCAAGTA

TTTCAAGTTGCTGAAGAACATGCACCATCCATCATGTTTACTGATGAAATTGAAGCCATTGGGACAAAAA

GATATGACTCCAATTCTGGTGGTGAGAGAGAAATTCAGCAAACAATGTTGGAATTGGAACTGTTGAACCA

ATTGGGTGGATTTGATTCTAGGGAAGATGTGAAAGTTATCATGGCCACAAAACAAGTAGAAACTTTGGAT

CCAGTACTTATCAGACCAGGCCGCATTGACAAGAAGATCGAGTTCCACCTGCCTGATGAAAAGACTAAGA

AGCACATCTTTCAGATTCACACAAGCAGGATGACACTGGCCAATGATGTAACCCTGGACGACTTGATCAT

GGCTAAAGATGACTTCTCTGGTGCTGACATCAAGGCAATCTGTACAGAAGCTGGTCTGATGGCCTTAAGA

GAACATAGAATGAAAGCAACAAATGAAGACTTCAAAAAATCTATAGAAAGTGTTCTTTATAAGAAACACG

AAGGCATCCCTGAGGGGCTTTATCTCTAG<u>TGAACCACCGCTGCCATCAGGAAGATGGTTGGGAGATTTCC</u>

<u>CAACCCCTGAAAGGGATGAGGTTGGGGGAG</u>

The nucleic acid sequence NOV5, located on chromosome 5 has 1347 of 1447 bases (93%) identical to a gb:GENBANK-ID:HUM26SPSIV|acc:L02426 mRNA from *Homo sapiens* (Human 26S protease (S4) regulatory subunit mRNA, complete cds (E=2.4e$^{-277}$).

A NOV5 polypeptide (SEQ ID NO:16) encoded by SEQ ID NO:15 is 442 amino acid residues and is presented using the one letter code in Table 5B. Signal P, Psort and/or Hydropathy results predict that NOV5 has no signal peptide and is likely to be localized in the cytoplasm with a certainty of 0.4500. In other embodiments, NOV5 may also be localized to the microbody (peroxisome) with a certainty of 0.3000, the mitochondrial matrix space with a certainty of 0.1000, or the lysosome (lumen) with a certainty of 0.1000.

TABLE 5B

NOV5 protein sequence (SEQ ID NO:16)
MGQSQGDGHGPRRGKKDEKDKKNKYEPLVPTRVAEKEEKTKGQDVASKLPLVTLHTQCRLKLLKLERIKDYLLM

VEEFIRNQEQIKLLEEKQEEGRSKVDDLRGTPMSVGNLEEIIDDNHAIVSTSVGSEHYDSIISFVEKDLLEPGC

SILLRHKVHAVIGVLMDDTGPLVTMMKVEKAPQETYVNTGGLDNQIQEIKESMELPLPHPEYYEEMGTKPPKGV

ILCGPPGTGKTLLAKAVANQTSATFLRVVGSELIQKYLGDGPKLVRQVFQVAEEHAPSIMFTDEIEAIGTKRYD

SNSGGEREIQQTMLELELLNQLGGFDSREDVKVIMATKQVETLDPVLIRPGRIDKKIEFHLPDEKTKKHIFQIH

TSRMTLANDVTLDDLIMAKDDFSGADIKAICTEAGLMALREHRMKATNEDFKKSIESVLYKKHEGIPEGLYL

The full amino acid sequence of the protein of the invention was found to have 383 of 442 amino acid residues (86%) identical to, and 405 of 442 amino acid residues (91%) similar to, the 440 amino acid residue ptnr:SWISSPROT-ACC:P49014 protein from *Mus musculus* (Mouse), and *Rattus norvegicus* (Rat) (26S Protease Regulatory Subunit 4 (P26S4) (E=1.7e$^{-200}$).

NOV5 also has homology to the amino acid sequences shown in the BLASTP data listed in Table 5C.

TABLE 5C

BLAST results for NOV5

| Gene Index/ Identifier | Protein/Organism | Length (aa) | Identity (%) | Positives (%) | Expect |
| --- | --- | --- | --- | --- | --- |
| gi\|4506207\|ref\|NP_0 02793.1\| (NM_002802) | proteasome (prosome, macropain) 26S subunit, ATPase, 1; Proteasome 26S subunit, ATPase, 1 [*Homo sapiens*] | 440 | 382/442 (86%) | 405/442 (91%) | 0.0 |
| gi\|6679501\|ref\|NP_0 32973.1\| (NM_008947) | protease (prosome, macropain) 26S subunit, ATPase 1 [*Mus musculus*] | 440 | 383/442 (86%) | 405/442 (90%) | 0.0 |
| gi\|345717\|pir\|\|A444 68 | 26S proteasome regulatory chain 4 [validated] - human | 440 | 381/442 (86%) | 404/442 (91%) | 0.0 |
| gi\|16741033\|gb\|AAH1 6368.1\|AAH16368 (BC016368) | protease (prosome, macropain) 26S subunit, ATPase 1 [*Homo sapiens*] | 440 | 382/442 (86%) | 404/442 (90%) | 0.0 |
| gi\|2492516\|sp\|Q9073 2\|PRS4_CHICK | 26S PROTEASE REGULATORY SUBUNIT 4 (P26S4) | 440 | 378/442 (85%) | 402/442 (90%) | 0.0 |

The homology of these sequences is shown graphically in the ClustalW analysis shown in Table 5D.

TABLE 5D

ClustalW Analysis of NOV5

1) NOV5 (SEQ ID NO:16)
2) gi|4506207|ref|NP_002793.1| (NM_002802) proteasome (prosome, TABLE 5D-continued ClustalW Analysis of NOV5 macropain) 26S subunit, ATPase, 1; Proteasome 26S subunit,
ATPAse, 1 [Homo sapiens] (SEQ ID NO:52)
3) gi|6679501|ref|NP_032973.1| (NM_008947) protease (prosome,
macropain) 26S subunit, ATPase 1 [Mus musculus]
(SEQ ID NO:53)
4) gi|345717|pir||A44468 26S proteasome regulatory chain 4
[validated] - human (SEQ ID NO:54)
5) gi|16741033|gb|AAH16368.1|AAH16368 (BC016368) protease
(prosome, macropain) 26S subunit, ATPase 1 [Homo sapiens]
(SEQ ID NO:55)
6) gi|2492516|sp|Q90732|PRS4_CHICK 26S PROTEASE REGULATORY
SUBUNIT 4 (P26S4) (SEQ ID NO:56)

```
                        10         20         30         40         50
                ....|....|....|....|....|....|....|....|....|....|
NOV5            MGQSQGDGHGPRRGKKDEKDKKNKYEPLVPTRVAEKEEKTKGQDVASKLP
gi|4506207|     MGQSQSGGHGPGGGKKDDEDKKKKYEPPVPTRVGKKKKKTKGPDAASKLP
gi|6679501|     MGQSQSGGHGPGGGKKDDKDKKKKYEPPVPTRVGKKKKKTKGPDAASKLP
gi|345717|      MGQSQSGGHGPGGGKKDDEDKKKKYEPPVPTRVGKKKKKRKGPDAASKLP
gi|16741033|    MGQSQSGGHGPGGGKKDDKDKKKKYEPPVPTRVGKKKKKTKGPDAASKLP
gi|2492516|     MGQSQSGGHGPGGGKKDDKDKKKKYEPPVPTRVGKKKKKTKGPDAASKPP 60         70         80         90        100
                ....|....|....|....|....|....|....|....|....|....|
NOV5            LVTLHTQCRLKLLKLERIKDYLLMVEEFIRNQEQRKLLEEKQEEGRSKVD
gi|4506207|     LVTPHTQCRLKLLKLERIKDYLLMEEEFIRNQEQMKPLEEKQEEERSKVD
gi|6679501|     LVTPHTQCRLKLLKLERIKDYLLMEEEFIRNQEQMKPLEEKQEEERSKVD
gi|345717|      LVTPHTQCRLKLLKLERIKDYLLMEEEFIRNQEQMKPLEEKQEEERSKVD
gi|16741033|    LVTPHTQCRLKLLKLERIKDYLLMEEEFIRNQEQMKPLEEKQEEERSKVD
gi|2492516|     LVTPHTQCRLKLLKLERIKDYLLMEEEFIRNQEQMKPLEEKQEEERSKVD 110        120        130        140        150
                ....|....|....|....|....|....|....|....|....|....|
NOV5            DLRGTPMSVGNLEEIIDDNHAIVSTSVGSEHYDSIESFVEKDLLEPGCSI
gi|4506207|     DLRGTPMSVGTLEEIIDDNHAIVSTSVGSEHYVSILSFVDKDLLEPGCSV
gi|6679501|     DLRGTPMSVGTLEEIIDDNHAIVSTSVGSEHYVSILSFVDKDLLEPGCSV
gi|345717|      DLRGTPMSVGTLEEIIDDNHAIVSTSVGSEHYVSILSFVDKDLLEPGCSV
gi|16741033|    DLRGTPMSVGTLEEIIDDNRAIVSTSVGSEHYVSILSFVDKDLLEPGCSV
gi|2492516|     DLRGTPMSVGTLEEIIDDNHAIVSTSVGSEHYVSILSFVDKDLLEPGCSV 160        170        180        190        200
                ....|....|....|....|....|....|....|....|....|....|
NOV5            LLRHKVHAVIGVLMDDTGPLVTMMKVEKAPQETYVNTGGLDNQIQEIKES
gi|4506207|     LLNHKVHAVIGVLMDDTDPLVTVMKVEKAPQETYADIGGLDNQIQEIKES
gi|6679501|     LLNHKVHAVIGVLMDDTDPLVTVMKVEKAPQETYADIGGLDNQIQEIKES
gi|345717|      LLNHKVHAVIGVLMDDTDPLVTVMKVEKAPQETYADIGGLDNQIQEIKES
gi|16741033|    LLNHKVHAVIGVLMDDTDPLVTVMKVEKAPQETYADIGGLDNQIQEIKES
gi|2492516|     LLNHKVHAVIGVLMDDTDPLVTVMKEEKAPQETYADIGGLDNQIQEIKES 210        220        230        240        250
                ....|....|....|....|....|....|....|....|....|....|
NOV5            MELPLPHPEYYEEMGTKPPKGVILCGPPGTGKTLLAKAVANQTSATFLRV
gi|4506207|     VELPLTHPEYYEEMGIKPPKGVILYGPPGTGKTLLAKAVANQTSATFLRV
gi|6679501|     VELPLTHPEYYEEMGIKPPKGVILYGPPGTGKTLLAKAVANQTSATFLRV
gi|345717|      VELPLTHPEYYEEMGIKPPKGVILYGPPGTGKTLLAKAVANQTSATFLRV
gi|16741033|    VELPLTHPEYYEEMGIKPPKGVILYGPPGTGKTLLAKAVANQTSATFLRV
gi|2492516|     VELPLTHPEYYEEMGIKPPKGVILYGPPGTGKTLLAKAVANQTSATFLRV 260        270        280        290        300
                ....|....|....|....|....|....|....|....|....|....|
NOV5            VGSELIQKYLGDGPKLVRQVFQVAEEHAPSIMFIDEIEAIGTKRYDSNSG
gi|4506207|     VGSELIQKYLGDGPKLVRELFRVAEEHAPSIVFIDEIDAIGTKRYDSNSG
gi|6679501|     VGSELIQKYLGDGPKLVRELFRVAEEHAPSIVFIDEIDAIGTKRYDSNSG
gi|345717|      VGSELIQKYLGDGPKLVRELFRVAEEHAPSIVFIDEIDAIGTKRYDSNSG
gi|16741033|    VGSELIQKYLGDGPKLVRELFRVAEEHAPSIVFIDEIDAIGTKRYDSNSG
gi|2492516|     VGSELIQKYLGDGPKLVRELFRVAEEHGPSIVFIDEIDAIGTKRYDSNSG 310        320        330        340        350
                ....|....|....|....|....|....|....|....|....|....|
NOV5            GEREIQQTMLELELLNQLGGFDSREDVKVIMATKQVETLDPVLIRPGRID
gi|4506207|     GEREIQRTM--LELLNQLDGFDSRGDVKVIMATNRIETLDPALIRPGRID
gi|6679501|     GEREIQRTM--LELLNQLDGFDSRGDVKVIMATNRIETLDPALIRPGRID
gi|345717|      GEREIQRTM--LELLNQLDGFDSRGDVKVIMATNRIETLDPALIRPGRID
gi|16741033|    GEREIQRTM--LELLNQLDGFDSRGDVKVIMATNRIETLDPALIRPGRID
gi|2492516|     GEREIQRTM--LELLNQLDGFDSRGDVKVIMATNRIETLDPALIRPGRID
```

TABLE 5D-continued

ClustalW Analysis of NOV5

```
              360        370        380        390        400
         ....|....|....|....|....|....|....|....|....|....|..
NOV5      KKIEFHLPDEKTKKHIFQIHTSRMTLANDVTLDDLIMAKDDFSGADIKAI
gi|4506207|   RKIEFPLPDEKTKKRIFQIHTSRMTLADDVTLDDLIMAKDDLSGADIKAI
gi|6679501|   RKIEFPLPDEKTKKRIFQIHTSRMTLADDVTLDDLIMAKDDLSGADIKAI
gi|345717|    RKIEFPLPDEKTKKRIFQIHTSRMTLADDVTLDDLIMAKDDLSGADIKAI
gi|16741033|  RKIEFPLPDEKTKKRIFQIHTSRMTLADDVTLDDLIMAKDDLSGADIKAI
gi|2492516|   RKIEFPLPDEKTKKRIFQIHTSRMTLADDVTLDSLIMAKDDLSGADIKAI 410        420        430        440
         ....|....|....|....|....|....|....|....|..
NOV5      CTEAGLMALREHRMKATNEDFKKSIESVLYKKHEGIPEGLYL
gi|4506207|   CTEAGLMALRERRMKVTNEDFKKSKENVLYKKQEGTPEGLYL
gi|6679501|   CTEAGLMALRERRMKVTNEDFKKSKENVLYKKQEGTPEGLYL
gi|345717|    CTEAGLMALRERRMKVTNEDFKKSKENVLYKKQEGTPEGLYL
gi|16741033|  CTEAGLMALRERRMKVTNEDFKKSKENVLYKKQEGTPEGLYL
gi|2492516|   CTEAGLMALRERRMKVTNEDFKKSKENFLYKKTEGTPEGLYL
```

Tables 5E–F list the domain description from DOMAIN analysis results against NOV5. This indicates that the NOV5 sequence has properties similar to those of other proteins known to contain this domain.

TABLE 5E

Domain Analysis of NOV5 gnl|Pfam|pfam00004, AAA, ATPase family associated with various cellular activities (AAA). AAA family proteins often perform chaperone-like functions that assist in the assembly, operation, or disassembly of protein complexes (SEQ ID NO:101)
CD-Length = 186 residues, 100.0% aligned
Score = 190 bits (483), Expect = 1e-49

```
NOV 4:  221  GVILCGPPGTKTLLAKAVANQTSATFLRVVGSELIQKYLGDGPKLVRQVFQVAEEHAPS  280
             |++| ||||||||||||||| +   |+ + ||||+ ||+|+  ||||  +| +| + ||
Sbjct:    1  GILLYGPPGTKTLLAKAVAKELGVPFIEISGSELLSKYVGESEKLVRALFSLARKSAPC   60

NOV 4:  281  IMFTDEIEAIGTKRYDSNSGGEREIQQTMLELELLNQLGGFDSREDVKVIMATKQVETLD  340
             |+| |||+|+  || |  +|      + +||  ++ ||+   +| ||  || + + ||
Sbjct:   61  IIFIDEIDADAPKRGDVGTGDVSS----RVVNQLLTEMDGFEKLSNVIVIGATNRPDLLD  116

NOV 4:  341  PVLIRPGRIDKKIEFHLPDEKTKKHIFQIHTSRMTLANDVTLDDLIMAKDDFSGADIKAI  400
             | |+|||| |++|| ||||++ + | +|| + | || ||++    |||||+ |+
Sbjct:  117  PALLRPGRFDRRIEVPLPDEEERLEILKIHLKKKPLEKDVDLDEIARRTPGFSGADLAAL  176

NOV 4:  401  CTEAGLMALR  410
             | ||| |  |+|
Sbjct:  177  CREAALRAIR  186
```

TABLE 5F

Domain Analysis of NOV5 gnl|Smart|smart00382, AAA, ATPases associated with a variety of cellular activities; AAA. This profile/alignment only detects a fraction of this vast family. The poorly conserved N-terminal helix is missing from the alignment. (SEQ ID NO:102)
CD-Length = 151 residues, 100.0% aligned
Score = 61.6 bits (148), Expect = 9e-11

```
NOV 4:  218  PPKGVILCGPPGTGKTLLAKAVANQTSATFLRVV-------------------GSELIQK  258
             | + |++ ||||+|||  ||+|+|  +    |+         |+                  |
Sbjct:    1  PGEVVLIVGPPGSGKTTLARALARELGPDGGGVIYIDGEDLREEALLQLLRLLVLVGEDK   60

NOV 4:  259  YLGDGPKLVRQVFQVAEEHAPSIMFTDEIEAIGTKRYDSNSGGEREIQQTMLELELLNQL  318
             |  | + +|   +| + |++  ||| ++         +   +|  ||| |
Sbjct:   61  LSGSGGQRIRLALALARKLKPDVLILDEITSLLDAEQE---------ALLLLLEELLRLL  111

NOV 4:  319  GGFDSREDVKVIMATKQVETLDPVLIRPGRIDKKIEFHLPD  359
             |+| ||   |  | |+| | |+|++|
Sbjct:  112  LLLLKEENVTVIETTNDETDLIPALLRR-RFDRRIVLLRIL  151
```

Ubiquitinated proteins are degraded by a 26S ATP-dependent protease. The protease is composed of a 20S catalytic proteasome and 2 PA700 regulatory modules. The PA700 complex is composed of multiple subunits, including at least 6 related ATPases and approximately 15 non-ATPase polypeptides. Tanahashi et al. (1998) stated that each of the 6 ATPases, namely PSMC1, PSMC2 (154365), PSMC3 (186852), PSMC4 (602707), PSMC5 (601681), and PSMC6 (602708), contains an AAA (ATPases associated with diverse cellular activities) domain (see PSMC5). Dubiel et al. (1992) cloned cDNAs encoding subunit 4 (S4) of the 26S protease by screening a HeLa cell cDNA library with probes that were produced using the protein sequence. The 440-amino acid protein has a molecular mass of 51 kD by SDS-PAGE. By fluorescence in situ hybridization, Tanahashi et al. (1998) mapped the human PSMC1 gene to 19p13.3. Hoyle and Fisher (1996) found that the human and mouse PSMC1 proteins have 99% amino acid identity. They reported that the mouse Psmc1 gene contains at least 11 exons. By analysis of an interspecific backcross, Hoyle and Fisher (1996) mapped the mouse Psmc1 gene to chromosome 12. Nomenclature note: The PSMC1 gene product, which Dubiel et al. (1992) called subunit 4 (S4), is distinct from the PSMC4 (602707) gene product.

The disclosed NOV5 nucleic acid of the invention encoding a 26S protease regulatory subunit 4-like protein includes the nucleic acid whose sequence is provided in Table 5A or a fragment thereof. The invention also includes a mutant or variant nucleic acid any of whose bases may be changed from the corresponding base shown in Table 5A while still encoding a protein that maintains its 26S protease regulatory subunit 4-like activities and physiological functions, or a fragment of such a nucleic acid. The invention further includes nucleic acids whose sequences are complementary to those just described, including nucleic acid fragments that are complementary to any of the nucleic acids just described. The invention additionally includes nucleic acids or nucleic acid fragments, or complements thereto, whose structures include chemical modifications. Such modifications include, by way of nonlimiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject. In the mutant or variant nucleic acids, and their complements, up to about 7 percent of the bases may be so changed.

The disclosed NOV5 protein of the invention includes the 26S protease regulatory subunit 4-like protein whose sequence is provided in Table 5B. The invention also includes a mutant or variant protein any of whose residues may be changed from the corresponding residue shown in Table 5B while still encoding a protein that maintains its 26S protease regulatory subunit 4-like activities and physiological functions, or a functional fragment thereof. In the mutant or variant protein, up to about 14 percent of the residues may be so changed.

The protein similarity information, expression pattern, and map location for the 26S protease regulatory subunit 4-like protein and nucleic acid (NOV5) disclosed herein suggest that this NOV5 protein may have important structural and/or physiological functions characteristic of the 26S protease regulatory subunit 4 family. Therefore, the NOV5 nucleic acids and proteins of the invention are useful in potential diagnostic and therapeutic applications. These include serving as a specific or selective nucleic acid or protein diagnostic and/or prognostic marker, wherein the presence or amount of the nucleic acid or the protein are to be assessed, as well as potential therapeutic applications such as the following: (i) a protein therapeutic, (ii) a small molecule drug target, (iii) an antibody target (therapeutic, diagnostic, drug targeting/cytotoxic antibody), (iv) a nucleic acid useful in gene therapy (gene delivery/gene ablation), and (v) a composition promoting tissue regeneration in vitro and in vivo.

The NOV5 nucleic acids and proteins of the invention are useful in potential diagnostic and therapeutic applications implicated in various diseases and disorders described below. For example, the compositions of the present invention will have efficacy for treatment of patients suffering from cataract and Aphakia, Alzheimer's disease, neurodegenerative disorders, inflammation and modulation of the immune response, viral pathogenesis, aging-related disorders, neurologic disorders, cancer and/or other pathologies. The NOV5 nucleic acids, or fragments thereof, may further be useful in diagnostic applications, wherein the presence or amount of the nucleic acid or the protein are to be assessed.

NOV5 nucleic acids and polypeptides are further useful in the generation of antibodies that bind immunospecifically to the novel substances of the invention for use in therapeutic or diagnostic methods. These antibodies may be generated according to methods known in the art, using prediction from hydrophobicity charts, as described in the "Anti-NOVX Antibodies" section below. For example, the disclosed NOV5 protein has multiple hydrophilic regions, each of which can be used as an immunogen. In one embodiment, a contemplated NOV5 epitope is from about amino acids 5 to 50. In another embodiment, a NOV5 epitope is from about amino acids 75 to 125. In additional embodiments, NOV5 epitopes are from about amino acids 175 to 225, from about amino acids 280 to 320, from about amino acids 330 to 380, and from about amino acids 390 to 440. These novel proteins can be used in assay systems for functional analysis of various human disorders, which will help in understanding of pathology of the disease and development of new drug targets for various disorders.

NOV6

A disclosed NOV6 nucleic acid of 1020 nucleotides (also referred to as GMAC073364_A_da1) encoding a novel MITSUGUMIN29-like protein is shown in Table 6A. An open reading frame was identified beginning with an ATG initiation codon at nucleotides 2–4 and ending with a TAA codon at nucleotides 818–820. Putative untranslated regions upstream from the initiation codon and downstream from the termination codon are underlined in Table 6A, and the start and stop codons are in bold letters.

TABLE 6A

NOV6 Nucleotide Sequence (SEQ ID NO:17)

```
CATGTCCTCGACCGAGAGCGCCGGCCGCACGGCGGACAAGTCGCCGCGCCAGCAGGTGGACC

GCCTACTCGTGGGGCTGCGCTGGCGGCGGCTGGAGGAGCCGCTGGGCTTCATCAAAGTTCTC

CAGTGGCTCTTTGCTATTTTCGCCTTCGGGTCCTGTGGCTCCTACAGCGGGGAGACAGGAGC

AATGGTTCGCTGCAACAACGAAGCCAAGGACGTGAGCTCCATCATCGTTGCATTTGGCTATC

CCTTCAGGTTGCACCGGATCCAATATGAGATGCCCCTCTGCGATGAAGAGTCCAGCTCCAAG

ACCATGCACCTCATGGGGGACTTCTCTGCACCCGCCGAGTTCTTCGTGACCCTTGCAQTCTT

TTCCTTCTTCTATACCATGGCTGCCCTAGTTATCTACCTGCGCTTCCACAACCTCTACACAG

AGAACAAACGCTTCCCGCTGGTGGACTTCTGTGTGACTGTCTCCTTCACCTTCTTCTGGCTG

GTAGCTGCAGCTGCCTGGGGCAAGGGCCTGACCGATGTCAAGGGGGCCACACGACCATCCAG

CTTGACAGCAGCCATGTCAGTGTGCCATGGAGAGGAAGCAGTGTGCAGTGCCGGGGCCACGC

CCTCTATGGGCCTGGCCAACATCTCCGTGCTCTTTGGCTTTATCAACTTCTTCCTGTGGGCC

GGGAACTGTTGGTTTGTGTTCAAGGAGACCCCGTGGCATGGACAGGGCCAGGGCCAGGACCA

GGACCAGGACCAGGACCAGGGCCAGGGTCCCAGCCAGGAGAGTGCAGCTGAGCAGGGAGCAG

TGGAGAAGCAGTAAGCAGCCCCCCACCT
```

The NOV6 nucleic acid was identified on chromosome 3 and has 727 of 805 bases (90%) identical to a gb:GENBANK-ID:AB004816|acc:AB004816.1 mRNA from *Oryctolagus cuniculus* (*Oryctolagus cuniculus* mRNA for mitsugumin29, complete cds (E=2.5e$^{-142}$).

A disclosed NOV6 polypeptide (SEQ ID NO:18) encoded by SEQ ID NO:17 is 272 amino acid residues and is presented using the one-letter code in Table 6B. Signal P, Psort and/or Hydropathy results predict that NOV6 has a signal peptide and is likely to be localized on the plasma membrane with a certainty of 0.6000. In other embodiments, NOV6 may also be localized to the Golgi body with acertainty of 0.4000, the endoplasmic reticulum (membrane) with a certainty of 0.3000, or the nucleus with a certainty of 0.1000. The most likely celavage site for NOV6 is between positions 57 and 58, SYS-GE.

Based on the semi quantitative PCR, NOV6 is specially expressed in: Skeletal muscle, Heart, Kidney, Adrenal gland and one of the Lung cancer cell lines (Lung cancer NCI-H522) at a measurably higher level than the following tissues: Endothelial cells, Pancreas, Thyroid, Salivary gland, Pituitary gland, Brain (fetal), Brain (whole), Brain (amygdala), Brain (cerebellum), Brain (hippocampus), Brain (thalamus), Cerebral Cortex, Spinal cord, Bone marrow, Thymus, Spleen, Lymph node, Colorectal, Stomach, Small intestine, Bladder, Trachea, Kidney (fetal), Liver, Liver (fetal), Lung, Lung (fetal), Mammary gland, Ovary, Uterus, Placenta, Prostate, Testis, Melanoma, Adipose and cancer cell lines including Breast cancer, CNS cancer, Colon cancer, Gastric cancer, Lung cancer (except Lung cancer NCI-H522), Ovarian cancer, Pancreatic cancer, and Renal cancer.

In addition, NOV6 is predicted to be expressed in skeletal muscle because of the expression pattern of (GENBANK-

TABLE 6B

Encoded NOV6 protein sequence (SEQ ID NO:18)

```
MSSTESAGRTADKSPRQQVDRLLVGLRWRRLEEPLGFIKVLQWLFAIFAFGSCGSYSGETGAMVRCNNEAKD

VSSIIVAFGYPFRLHRIQYEMPLCDEESSSKTMHLMGDFSAPAEFFVTLGIFSFFYTMAALVIYLRFHNLYT

ENKRFPLVDFCVTVSFTFFWLVAAAAWGKGLTDVKGATRPSSLTAAMSVCHGEEAVCSAGATPSMGLANISV

LFGFIMFFLWAGNCWFVFKETPWHGQGQGQDQDQDQDQGQGPSQESAAEQGAVEKQ
```

The disclosed NOV6 amino acid sequence has 727 of 805 amino acid residues (90%) identical to, and 727 of 805 amino acid residues (90%) similar to, the 3489 amino acid residue gb:GENBANK-ID:AB004816|acc:AB004816.1 protein from *Oryctolagus cuniculus* (*Oryctolagus cuniculus* mRNA for mitsugumin29, complete cds) (E=2.5e$^{-142}$).

ID: gb:GENBANK-ID:AB004816|acc:AB004816.1) a closely related mitsugumin29 homolog in *Oryctolagus cuniculus*.

NOV6 also has homology to the amino acid sequences shown in the BLASTP data listed in Table 6C.

TABLE 6C

BLAST results for NOV6

| Gene Index/ Identifier | Protein/Organism | Length (aa) | Identity (%) | Positives (%) | Expect |
|---|---|---|---|---|---|
| gi\|3077703\|dbj\|BAA25784.1\|(AB004816) | mitsugumin29 [*Oryctolagus cuniculus*] | 264 | 252/272 (92%) | 256/272 (93%) | e-136 |
| gi\|6678874\|ref\|NP_032622.1\| (NM_008596) | mitsugumin 29 [*Mus musculus*] | 264 | 246/272 (90%) | 258/272 (94%) | e-133 |
| gi\|12836843\|dbj\|BAB23831.1\| (AK005132) | putative [*Mus musculus*] | 285 | 118/251 (47%) | 158/251 (62%) | 7e-59 |
| gi\|1351168\|sp\|P20488\|SYPH_BOVIN | SYNAPTOPHYSIN (MAJOR SYNAPTIC VESICLE PROTEIN P38) | 307 | 109/221 (49%) | 145/221 (65%) | 3e-58 |
| gi\|2134413\|pir\|\|I50720 | synaptophysin IIa - chicken | 268 | 109/217 (50%) | 142/217 (65%) | 4e-57 |

The homology of these sequences is shown graphically in the ClustalW analysis shown in Table 6D.

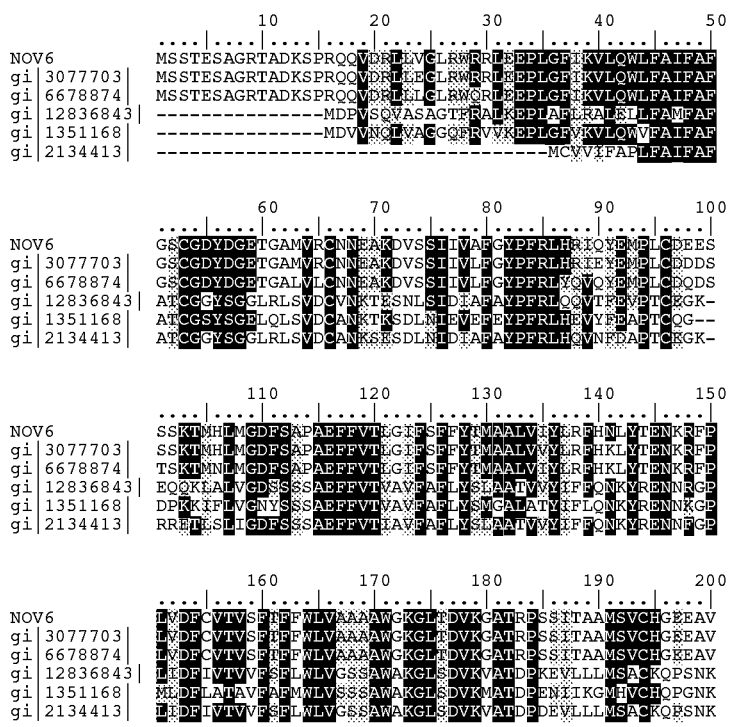

TABLE 6D

Clustal W Sequence Alignment

1) NOV6 (SEQ ID NO:18)
2) gi|3077703|dbj|BAA25784.1| (AB004816) mitsugumin29 [*Oryctolagus cuniculus*] (SEQ ID NO:57)
3) gi|6678874|ref|NP_032622.1| (NM_008596) mitsugumin 29 [*Mus musculus*] (SEQ ID NO:58)
4) gi|12836843|dbj|BAB23831.1| (AK005132) putative [*Mus musculus*] (SEQ ID NO:59)
5) gi|1351168|sp|P20488|SYPH_BOVIN SYNAPYOPHYSIN (MAJOR SYNAPTIC VESICLE PROTEIN P38) (SEQ ID NO:60)
6) gi|2134413|pir||I50720 synaptophysin IIa - chicken (SEQ ID NO:61)

TABLE 6D-continued

Clustal W Sequence Alignment

```
                  210       220       230       240       250
              ....|....|....|....|....|....|....|....|....|....|
NOV6          CSAGATPSMGLANISVLFGFINFFLWAGNCWFVFKETPWHGQGQGQDQDQ
gi|3077703|   CSAGATPSMGLANISVLFGFINFFLWAGNCWFVFKETPWHGQGQ-----
gi|6678874|   CSAGATPSMGLANISVLFGFINFFLWAGNCWFVFKETPWHGQGQ-----
gi|12836843|  CMAVHSPVMSSLNTSVVFGFLNFILWAGNIWFVFKETGWHSSGQRYLSDP
gi|1351168|   CKELRDPVTSGLNTSVYFGFLNLVLWVGNLWFVFKETGWAAPFLRAPPGA
gi|2134413|   CLPVRSPVMSSLNTSVVFGFLNFILWAGNIWFVFKETGWHSSGQRHAADT 260       270       280       290       300
              ....|....|....|....|....|....|....|....|....|....|
NOV6          DQDC------------GQGP----SQESAAEQG-----------------
gi|3077703|   --DC------------GQGP----SQESAAEQG-----------------
gi|6678874|   --DC------------GQGP----SQESAAEQG-----------------
gi|12836843|  MEKH--------SSSYNQG--RYN-QESYGSSGGYS----QQAN-----L
gi|1351168|   PEKQPAPGDAYGQAGYGQGEGGYGPGDSYGPQGGYQPDYGQPASSGGGGY
gi|2134413|   MEKQ--------SSGYNQG--GYN-QESYGPAGGYN----QPGS-----Y 310       320
              ....|....|....|....|
NOV6          -------------------AVEKQ-
gi|3077703|   -------------------AVEKQ-
gi|6678874|   -------------------AVEKQ-
gi|12836843|  GPTSDEFGQQP----SGPTSFNNQI
gi|1351168|   GPQG-DYGQQGYGPQGAPTSFSNQM
gi|2134413|   GQVG-DYGQPQSYGQSGPTSFANQI
```

Table 6E lists the domain description from DOMAIN analysis results against NOV6. This indicates that the NOV6 sequence has properties similar to those of other proteins known to contain this domain.

TABLE 6E

Domain Analysis of NOV6 gnl|Pfam|pfam01284, Synaptophysin, Synaptophysin/synaptoporin.
(SEQ ID NO:103)
CD-Length = 298 residues, 70.8% aligned
Score = 244 bits (622), Expect = 6e-66

```
NOV 5:   29  RRLEEPLGFIKVLQWLFAIFAFGSCGSYSGETGAMVRCNNEAKDVSSIIVAFGYPFRLHR  88
             +   ||||+|||||+||||||  +|| ||||     |  | |+ +   +| +|| |||||
Sbjct:    3  MVIFAPLGFVKVLQWVFAIFAFATCGGYSGELQLSVDCANKTESDLNIDIAFAYPFRLHE  62

NOV 5:   89  IQYEMPLCDEESSSKTMHLMGDFSAPAEFFVTLGIFSFFYTMAALVIYLRFHNLYTENKR 148
             + +|  |  |     |  + |+|| |+ ||||||+  +|+|  |++|||   |+ |||  +
Sbjct:   63  VTFEAPTC-EGDEKKNIALVGDSSSSAEFFVTVAVFAFLYSLAALATYIFFQNKYRENNK 121

NOV 5:  149  FPLVDFCVTVSFTFFWLVAAAAWGKGLTDVKGATRPSSLTAAMSVCHGEEAVCSAGATPS 208
             ||+||   |   |  |||  ++||   |||+|||  ||| +     |  ||       |
Sbjct:  122  GPLIDFIATAVFAFLWLVGSSAWAKGLSDVKMATDPEEIIKGMHAVHQPGNKCKELHDPV 181

NOV 5:  209  MGLANISVLFGFINFFLWAGNCWFVFKETPWH 240
             |   |  ||+|||+||  ||||| ||||||| |
Sbjct:  182  MSGLNTSVVFGFLNFILWAGNIWFVFKETGWA 213
```

In skeletal muscle, excitation-contraction (E-C) coupling requires the conversion of the depolarization signal of the invaginated surface membrane, namely the transverse (T-) tubule, to Ca2+ release from the sarcoplasmic reticulum (SR) (Takeshima H et al., Biochem J 1998 Apr. 1;331 (Pt 1):317–22/PMID: 9512495, UI: 98180964). Signal transduction occurs at the junctional complex between the T-tubule and SR, designated as the triad junction, which contains two components essential for E-C coupling, namely the dihydropyridine receptor as the T-tubular voltage sensor and the ryanodine receptor as the SR Ca2+-release channel. However, functional expression of the two receptors seemed to constitute neither the signal-transduction system nor the junction between the surface and intracellular membranes in cultured cells, suggesting that some as-yet-unidentified molecules participate in both the machinery. In addition, the molecular basis of the formation of the triad junction is totally unknown. It is therefore important to examine the components localized to the triad junction. Takeshima et al. report the identification using monoclonal antibody and primary structure by cDNA cloning of mitsugumin29, a novel transmembrane protein from the triad junction in skeletal muscle. This protein is homologous in amino acid sequence and shares characteristic structural features with the members of the synaptophysin family. The subcellular distribution and protein structure suggest that mitsugumin29 is involved in communication between the T-tubular and junctional SR membranes.

Physiological roles of the members of the synaptophysin family, carrying four transmembrane segments and being basically distributed on intracellular membranes including synaptic vesicles, have not been established yet (Nishi M et al., J Cell Biol 1999 Dec. 27;147(7):1473–80/PMID: 10613905, UI: 20082885). Recently, mitsugumin29 (MG29) was identified as a novel member of the synaptophysin family from skeletal muscle. MG29 is expressed in the junctional membrane complex between the cell surface transverse (T) tubule and the sarcoplasmic reticulum (SR), called the triad junction, where the depolarization signal is converted to Ca(2+) release from the SR. In this study, Nishi et al. examined biological functions of MG29 by generating knockout mice. The MG29-deficient mice exhibited normal health and reproduction but were slightly reduced in body weight. Ultrastructural abnormalities of the membranes around the triad junction were detected in skeletal muscle from the mutant mice, i.e., swollen T tubules, irregular SR structures, and partial misformation of triad junctions. In the mutant muscle, apparently normal tetanus tension was observed, whereas twitch tension was significantly reduced. Moreover, the mutant muscle showed faster decrease of twitch tension under Ca(2+)-free conditions. The morphological and functional abnormalities of the mutant muscle seem to be related to each other and indicate that MG29 is essential for both refinement of the membrane structures and effective excitation-contraction coupling in the skeletal muscle triad junction. These results further imply a role of MG29 as a synaptophysin family member in the accurate formation of junctional complexes between the cell surface and intracellular membranes.

The temporal appearance and subcellular distribution of mitsugumin29 (MG29), a 29-kDa transmembrane protein isolated from the triad junction in skeletal muscle, were examined by immunohistochemistry during the development of rabbit skeletal muscle (Komazaki S et al., Dev Dyn 1999 June;215(2):87–95/PMID: 10373013, UI: 99300228). MG29 appeared in the sarcoplasmic reticulum (SR) in muscle cells at fetal day 15 before the onset of transverse tubule (T tubule) formation. In muscle cells at fetal day 27, in which T tubule and triad formation is ongoing, both SR and triad were labeled for MG29. In muscle cells at newborn 1 day, the labeling of the SR had become weak and the triads were well developed and clearly labeled for MG29. Specific and clear labeling for MG29 was restricted to the triads in adult skeletal muscle cells. When MG29 was expressed in amphibian embryonic cells by injection of the cRNA, a large quantity of tubular smooth-surfaced endoplasmic reticulum (sER) was formed in the cytoplasm. The tubular sER was 20–40 nm in diameter and appeared straight or reticular in shape. The tubular sER was formed by the fusion of coated vesicles [budded off from the rough-surfaced endoplasmic reticulum (rER)] and vacuoles of rER origin. The present results suggest that MG29 may play important roles both in the formation of the SR and the construction of the triads during the early development of skeletal muscle cells.

Recently mitsugumin29 unique to the triad junction in skeletal muscle was identified as a novel member of the synaptophysin family; the members of this family have four transmembrane segments and are distributed on intracellular vesicles. In this study, Shimuta et al. FEBS Lett 1998 Jul. 17;431(2):263–7/PMID: 9708916, UI: 98372647, isolated and analyzed mouse mitsugumin29 cDNA and genomic DNA containing the gene. The mitsugumin29 gene mapped to the mouse chromosome 3 F3-H2 is closely related to the synaptophysin gene in exon-intron organization, which indicates their intimate relationship in molecular evolution. RNA blot hybridization and immunoblot analysis revealed that mitsugumin29 is expressed abundantly in skeletal muscle and at lower levels in the kidney. Immunofluorescence microscopy demonstrated that mitsugumin29 exists specifically in cytoplasmic regions of the proximal and distal tubule cells in the kidney. The results obtained may suggest that mitsugumin29 is involved in the formation of specialized endoplasmic reticulum systems in skeletal muscle and renal tubule cells.

The disclosed NOV6 nucleic acid of the invention encoding a MITSUGUMIN29-like protein includes the nucleic acid whose sequence is provided in Table 6A or a fragment thereof. The invention also includes a mutant or variant nucleic acid any of whose bases may be changed from the corresponding base shown in Table 6A while still encoding a protein that maintains its MITSUGUMIN29-like activities and physiological functions, or a fragment of such a nucleic acid. The invention further includes nucleic acids whose sequences are complementary to those just described, including nucleic acid fragments that are complementary to any of the nucleic acids just described. The invention additionally includes nucleic acids or nucleic acid fragments, or complements thereto, whose structures include chemical modifications. Such modifications include, by way of nonlimiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject. In the mutant or variant nucleic acids, and their complements, up to about 10 percent of the bases may be so changed.

The disclosed NOV6 protein of the invention includes the MITSUGUMIN29-like protein whose sequence is provided in Table 6B. The invention also includes a mutant or variant protein any of whose residues may be changed from the corresponding residue shown in Table 6B while still encoding a protein that maintains its MITSUGUMIN29-like activities and physiological functions, or a functional fragment thereof. In the mutant or variant protein, up to about 10 percent of the residues may be so changed.

The NOV6 nucleic acids and proteins of the invention are useful in potential therapeutic applications implicated in eye/lens disorders including but not limited to muscular dystrophy, Lesch-Nyhan syndrome, myasthenia gravis, diabetes, autoimmune disease, renal artery stenosis, interstitial nephritis, glomerulonephritis, polycystic kidney disease, systemic lupus erythematosus, renal tubular acidosis, IgA nephropathy, hypercalceimia, cardiomyopathy, atherosclerosis, hypertension, congenital heart defects, aortic stenosis, atrial septal defect (ASD), atrioventricular (A-V) canal defect, ductus arteriosus, pulmonary stenosis, subaortic stenosis, ventricular septal defect (VSD), valve diseases, tuberous sclerosis, scleroderma, obesity, transplantation, adrenoleukodystrophy, congenital adrenal hyperplasia, and other diseases, disorders and conditions of the like. Also since the invention is highly expressed in one of the lung cancer cell lines (Lung cancer NCI-H522), it may be useful in diagnosis and treatment of this cancer. The NOV6 nucleic acid, or fragments thereof, may further be useful in diagnostic applications, wherein the presence or amount of the nucleic acid or the protein are to be assessed.

NOV6 nucleic acids and polypeptides are further useful in the generation of antibodies that bind immunospecifically to the novel substances of the invention for use in therapeutic or diagnostic methods. These antibodies may be generated according to methods known in the art, using prediction from hydrophobicity charts, as described in the "Anti-NOVX Antibodies" section below. For example the disclosed NOV6 protein have multiple hydrophilic regions, each of which can be used as an immunogen. In one embodiment, contemplated NOV6 epitope is from about amino acids 10 to 40. In other embodiments, NOV6 epitope is from about amino acids 60 to 70, from about amino acids 90 to 130, from about amino acids 145 to 155, from about amino acid 170 to 180, and from about amino acids 220 to 270. This novel protein also has value in development of powerful assay system for functional analysis of various human disorders, which will help in understanding of pathology of the disease and development of new drug targets for various disorders.

NOV7

A disclosed NOV7 nucleic acid of 1020 nucleotides (also referred to as 106973211_EXT) encoding a novel Wnt-15-like protein is shown in Table 7A. An open reading frame was identified beginning with an CTG initiation codon at nucleotides 2–4 and ending with a TAG codon at nucleotides 995–997. A putative untranslated region upstream from the initiation codon and downstream from the termination codon is underlined in Table 7A, and the start and stop codons are in bold letters. Since the starting codon is not a traditional initiation codon, NOV7 could represent a partial reading frame, and could further extend in the 5' direction.

TABLE 7A

NOV7 Nucleotide Sequence (SEQ ID NO:19)

<u>C</u>CTGACCGGGCGGGAAGTCCTGACGCCCTTCCCAGGATTGGGCACTGCGGCAGCCCCGGCACAGGGCGGG

GCCCACCTGAAGCAGTGTGACCTGCTGAAGCTGTCCCGGCGGCAGAAGCAGCTCTGCCGGAGGGAGCCCG

GCCTGGCTGAGACCCTGAGGGATGCTGCGCACCTCGGCCTGCTTGAGTGCCAGTTTCAGTTCCGGCATGA

GCGCTGGAACTGTAGCCTGGAGGGCAGGATGGGCCTGCTCAAGAGAGGCTTCAAAGAGACAGCTTTCCTG

TACGCGGTGTCCTCTGCCGCCCTCACCCACACCCTGGCCCGGGCCTGCAGCGCTGGGCGCATGGAGCGCT

GCACCTGTGATGACTCTCCGGGGCTGGAGAGCCGGCAGGCCTGGCAGTGGGGCGTGTGCGGTGACAACCT

CAAGTACAGCACCAAGTTTCTGAGCAACTTCCTGGGGTCCAAGAGAGGAAACAAGGACCTGCGGGCACGG

GCAGACGCCCACAATACCCACGTGGGCATCAAGGCTGTGAAGAGTGGCCTCAGGACCACGTGTAAGTGCC

ATGGCGTATCAGGCTCCTGTGCCGTGCGCACCTGCTGGAAGCAGCTCTCCCCGTTCCGTGAGACGGGCCA

GGTGCTGAAACTGCGCTATGACTCGGCTGTCAAGGTGTCCAGTGCCACCAATGAGGCCTTGGGCCGCCTA

GAGCTGTGGGCCCTGCCAGGCAGGGCAGCCTCACCAAAGGCCTGGCCCCAAGGTCTGGGGACCTGGTGT

ACATGGAGGACTCACCCAGCTTCTGCCGGCCCAGCAAGTACTCACCTGGCACAGCAGGTAGGGTGTGCTC

CCGGGAGGCCAGCTGCAGCAGCCTGTGCTGCGGGCGGGCTATGACACCCAGAGCCGCCTGGTGGCCTTC

TCCTGCCACTGCCAGGTGCAGTGGTGCTGCTACGTGGAGTGCCAGCAATGTGTGCAGGAGGAGCTTGTGT

ACACCTGCAAGCACTAG<u>GCCTACTGCCCAGCAAGCCAGTC</u>

The disclosed NOV7 nucleic acid sequence, located on chromosome 17, has 688 of 1009 bases (68%) identical to a gb:GENBANK-ID:AF031168|acc:AF031168.1 mRNA from *Gallus gallus* (*Gallus gallus* Wnt-14 protein (Wnt-14) mRNA, complete cds) (E=3.0e$^{-76}$).

A disclosed NOV7 polypeptide (SEQ ID NO:20) encoded by SEQ ID NO:19 is 331 amino acid residues and is presented using the one-letter amino acid code in Table 7B. Signal P, Psort and/or Hydropathy results predict that NOV7 contains no signal peptide and is likely to be localized in the cytoplasm with a certainty of 0.4500. In other embodiments, NOV7 is also likely to be localized to the microbody (peroxisome) with a certainty of 0.3000, the mtochondrial matrix space with a certainty of 0.1000, or to the lysosome (lumen) with a certainty of 0.1000.

TABLE 7B

Encoded NOV7 protein sequence.

(SEQ ID NO:20)
LTGREVLTPFPGLGTAAAPAQGGAHLKQCDLLKLSRRQKQLCRREPGLAETLRDAAHLGLLECQFQFRHERWNCS

LEGRMGLLKRGFKETAFLYAVSSAALTHTLARACSAGRMERCTCDDSPGLESRQAWQWGVCGDNLKYSTKFLSNF

LGSKRGNKDLRARADAHNTHVGIKAVKSGLRTTCKCHGVSGSCAVRTCWKQLSPFRETGQVLKLRYDSAVKVSSA

TNEALGRLELWAPARQGSLTKGLAPRSGDLVYMEDSPSFCRPSKYSPGTAGRVCSREASCSSLCCGRGYDTQSRL

VAFSCHCQVQWCCYVECQQCVQEELVYTCKH

The disclosed NOV7 amino acid sequence has 205 of 330 amino acid residues (62%) identical to, and 252 of 330 amino acid residues (76%) similar to, the 354 amino acid residue ptnr:SWISSPROT-ACC:O42280 protein from *Gallus gallus* (Chicken) (WNT-14 Protein Precursor) (E=1.3e$^{-114}$).

The tissue expression of NOV7 is predicted to be expressed in brain because of the expression pattern of (GENBANK-ID: gb:GENBANK-ID:AF031168|acc:AF031168.1) a closely related *Gallus gallus* Wnt-14 protein (Wnt-14) mRNA, complete cds homolog.

NOV7 also has homology to the amino acid sequences shown in the BLASTP data listed in Table 7C.

TABLE 7C

BLAST results for NOV7

| Gene Index/ Identifier | Protein/Organism | Length (aa) | Identity (%) | Positives (%) | Expect |
|---|---|---|---|---|---|
| gi|16303264|dbj|BAB 70499.1 |(AB063483) | WNT14B [*Homo sapiens*] | 357 | 330/331 (99%) | 330/331 (99%) | e−175 |
| gi|3915306|sp|O4228 0|WN14_CHICK | WNT-14 PROTEIN PRECURSOR | 354 | 204/332 (61%) | 253/332 (75%) | e−109 |
| gi|15082261|ref|NP_ 003386.1| (NM_003395) | wingless-type MMTV integration site family, member 14 [*Homo sapiens*] | 365 | 209/335 (62%) | 255/335 (75%) | e−108 |
| gi|139748|sp|P10108 |WNT1_XENLA | WNT-1 PROTEIN PRECURSOR (XWNT-1) (XINT-1) | 371 | 120/313 (38%) | 175/313 (55%) | 5e−58 |
| gi|3024851|sp|O1490 5|WN15_HUMAN | WNT-15 PROTEIN | 120 | 120/120 (100%) | 120/120 (100%) | 2e−56 |

The homology of these sequences is shown graphically in the ClustalW analysis shown in Table 7D.

TABLE 7D

Information for the ClustalW proteins

1) NOV7 (SEQ ID NO:20)
2) gi|16303264|dbj|BAB70499.1| (AB063483) WNT14B
[Homo sapiens] (SEQ ID NO:62)
3) gi|3915306|sp|O42280|WN14_CHICK WNT-14 PROTEIN PRECURSOR
(SEQ ID NO:63)
4) gi|1508226|ref|NP_003386.1| (NM_003395) wingless-type MMTV
integration site family, member 14 [Homo sapiens]
(SEQ ID NO:64)
5) gi|139748|sp|P10108|WNT1_XENLA WNT-1 PROTEIN PRECURSOR
(XWNT-1) (XINT-1) (SEQ ID NO:65)
6) gi|3024851|sp|O14905|WN_HUMAN WNT-15 PROTEIN (SEQ ID NO:66)

```
                       10        20        30        40        50
                ....|....|....|....|....|....|....|....|....|....|
NOV7            ----------------------------------LTGRE-----VLTPFPGL
gi|16303264|    ------MRPPPALALAGLCLLALPAAAASYFGLTGRE-----VLTPFPGL
gi|3915306|     --------MALLRALLG--LLACTPRPSAAYFGLTCNE-----ALTILP-L
gi|15082261|    MLDGSPLARWLAAAFGLTLLLAALRPSAAYFGLTGSE-----PLTILP-L
gi|139748|      -------MRILTFLLGLKTLWVLAFSELSNTIAVNNSGKWWGIVNVASAG
gi|3024851|     --------------------------------------------------

60        70        80        90       100
                ....|....|....|....|....|....|....|....|....|....|
NOV7            GTAAAPAQGGAHLKQCDLLKLSRRQKQLCRREPGLAETLRDAAHLGLLEC
gi|16303264|    GTAAAPAQGGAHLKQCDLLKLSRRQKQLCRREPGLAETLRDAAHLGLLEC
gi|3915306|     TSEMEEAAVKAHYKVCDRLKLEKKQRRMCRRDPGGAETIMEAISMSALEC
gi|15082261|    TLEP-EAAAQAHYKACDRLKLEKKQRRMCRRDPGVAETLVEAVSMSALEC
gi|139748|      NVLPGSDARPVPLVLDPSLQLLSRQKRIIRQNPGILQSTTRGLHSAIREC
gi|3024851|     --------------------------------------------------

110       120       130       140       150
                ....|....|....|....|....|....|....|....|....|....|
NOV7            QFQFRHERWNCSLEG--RMG---LLKRGFKETAFLYAVSSAALTHTLARAC
gi|16303264|    QFQFRHERWNCSLEG--RTG---LLKRGFKETAFLYAVSSAALTHTLARAC
gi|3915306|     QYQFRFERWNCTLEGRYRAS---LLKRGFKETAFLYAISSAGLTHAMAKAC
gi|15082261|    QFQFRFERWNCTLEGRYRAS---LLKRGFKETAFLYAISSAGLTHALAKAC
gi|139748|      KWHFRNRRWNCPTGTGNQVFGKIINRGCRETAFVFAITSAGVTHSVARSC
gi|3024851|     --------------------------------------------------

160       170       180       190       200
                ....|....|....|....|....|....|....|....|....|....|
NOV7            SAGRMERCTCDDSPGLESRQAWQWGVCGDNLKYSTKFLSNFLGSKRGNKD
gi|16303264|    SAGRMERCTCDDSPGLESRQAWQWGVCGDNLKYSTKFLSNFLGSKRGNKD
gi|3915306|     SAGRMERCTCDEAPDLENREAWQWGCCGDNLKYSNKFVKEFLG-RKPNKD
gi|15082261|    SAGRMERCTCDEAPDLENRSAWQWGGCGDNLKYSSKFVKEFLG-RRSSKD
gi|139748|      SEGSIESCSCDYRRRGPGGPDWHWGGCSDNIEFGRFIGREFVDSSERGRD
gi|3024851|     --------------------------------------------------

210       220       230       240       250
                ....|....|....|....|....|....|....|....|....|....|
NOV7            LRARADAHNTHVGIKAVKSGLRITTCKCHGVSGSCAVRTCQKQLSPFRETG
gi|16303264|    LRARADAHNTHVGIKAVKSGLRTTCKCHGVSGSCAVRTCQKQLSPFRETG
gi|3915306|     LRARVDFHNNLVGMKVIKAGVETTCKCHGVSGSCVVRTCQRQLSPFHEIG
gi|15082261|    LRARVDFHNNLVGYKVIKAGVETTCKCHGVSGSCVVRTCQRQLAPFHEVG
gi|139748|      LKYLVNLHNNQAGRLTVLTEMRQECKCHGMSGSCSLRTCWMRLPPFRSVG
gi|3024851|     ----------------------------------SGSCAVRTCQKQLSPFRETG 260       270       280       290       300
                ....|....|....|....|....|....|....|....|....|....|
NOV7            QVLKLRYDSAVKVSSATNEALGRLELWAPAR---QGSLTKGLAPRSGDLV
gi|16303264|    QVLKLRYDSAVKVSSATNEALGRLELWAPAR---QGSLTKGLAPRSGDLV
gi|3915306|     KQLKQKYETSLKVCSTTNEATGE-GDISPPK--KSIPGHSDQIPRTTDLV
gi|15082261|    KHLKHKYETALKVCSTTNEAAGEAGAISPPRGRASGAGGSDPLPRTPELV
gi|139748|      DALKDRFDGASKVTYSNNGSNRWGSRSDPPH--LEPENPTHALPSSQDLV
gi|3024851|     QVLKLRYDSAVKVSSATNEALGRLELWAPAR---QGSLTKGLAPRSGDLV 310       320       330       340       350
                ....|....|....|....|....|....|....|....|....|....|
NOV7            YMEDSPSFCRPSKYS--PGTAGRVCSRE----ASCSSLCCGRGYRTQSRL
gi|16303264|    YMEDSPSFCRPSKYS--PGTAGRVCSRE----ASCSSLCCGRGYRTQSRL
gi|3915306|     YIDDSPSFCLMSRYS--PGTSGRKCYKD----KNCDSICCGRGHNTQSRV
gi|15082261|    HLEDSPSFCLAGRPS--PGTAGRRCHRE----KNCESICCGRGHNTQSRV
gi|139748|      VFENSPNFCSPSEKNGTPGTTGRICNSTSLGLDCELLCCGRGYRSLAEK
gi|3024851|     YMEDSPSFCRPSKYS--PGTAGRVCSRE----ASCSSLCCGRGYRTQSRL
```

TABLE 7D-continued

Information for the ClustalW proteins

```
                  360       370       380
             ....|....|....|....|....|....|.
NOV7         VAFSCHCQVQWCCYVECQQCVQEELVYTCKH
gi|16303264| VAFSCHCQVQWCCYVECQQCVQEELVYTCKH
gi|3915306|  VTRPCCQVRWCCYVECKQCTQREEVYTCKD
gi|15082261| VTRPCQCQVRWCCYVECRQCTQREEVYTCKG
gi|139748|   VTERCHCTFNWCQHVTCLNCTSSQIVHECL-
gi|3024851|  VAFSCHCQV----------------------
```

Tables 7E and 7F list the domain descriptions from DOMAIN analysis results against NOV7. This indicates that the NOV7 sequence has properties similar to those of other proteins known to contain this domain.

TABLE 7E

Domain Analysis of NOV7 gnl|Pfam|pfam00110, wnt, wnt family. (SEQ ID NO:104)
CD-Length = 313 residues, 97.8% aligned
Score = 268 bits (684), Expect = 5e-73

```
NOV 6:    34 LSRRQKQLCRREPGLAETLRDAAHLGLLECQFQFRHERWNCSLEGRMGL-----LKRGFK   88
             ||  ||+||||| | +  ++ + | | + ||| |||  |||||     |+ +    ||+| +
Sbjct:     8 LSPRQRQLCRRNPDVMASVSEGAQLAIQECQHQFRGRRWNCSTLDRLRVVFGKVLKKGTR   67

NOV 6:    89 ETAFLYAVSSAALTHTLARACSAGRMERCTCDDSPG-LESRQAWQWGVCGDNLKYSTKFL  147
             ||||+||+|||  + |  + ||||  +|  ||  |     + +|||| |  ||+++   +|
Sbjct:    68 ETAFVYAISSAGVAHAVTRACSEGELESCGCDYKKGPGGPQGSWQWGGCSDNVEFGIRFS  127

NOV 6:   148 SNFLGSKRGNKDLRARADAHVTHVGIKAVKSGLRTTCKCHGVSGSCAVRTCWKQLSPFRE  207
             |+ ++    +| |+  + ||     |  ||||| +|  ||||||||||+++|||   |  ||
Sbjct:   128 REFVDARERERDARSLMNLHNNEAGRKAVKSHMRRECKCHGVSGSCSMKTCWLSLPDFRA  187

NOV 6:   208 TGQVLKLRYDSAVKVSSATNEALGRLELWAPARQGSLTKGLAPRSGDLVYMEDSPSFCR-  266
             |  || +||  |++|          |  + ||     + |    ||||+||||  +|
Sbjct:   188 VGDALKDKYDGAIRV---EPNKRGMGQGSAFRLVAKNPRFKPPTRSDVLYLEDSPDYCER  244

NOV 6:   267 -PSKYSPGTAGRVCSREA----SCSSLCCGRGYDTQSRLVAFSCHCQVQWCCYVECQQCV  321
              |   ||  ||||||++ +     | ||||||||+||      |+|+  ||||+|++|
Sbjct:   245 DRSTGSLGTQGRVCNKTSKGLDGCELLCCGRGYNTQQVERTEKCNCKFHWCCYVKCEECQ  304

NOV 6:   322 QEELVYTCK  330
             +    |+|||
Sbjct:   305 EVVEVHTCK  313
```

TABLE 7F

Domain Analysis of NOV7 gnl|Smart|smart00097, WNT1, found in Wnt-1 (SEQ ID NO:105)
CD-Length = 304 residues, 98.7% aligned
Score = 248 bits (632), Expect = 5e-67

```
NOV 6:    34 LSRRQKQLCRREPGLAETLRDAAHLGLLECQFQFRHERWNCSLEGRMGL----LKRGFKE   89
             |||||+||||   |  +  ++ + | |+ ||| |||  |     +  |++| +|
Sbjct:     5 LSRRQRQLCRANPDVMASVAEGAQEGIEECQHQFRFRRWNCSTAGLASIFGKVLRQGTRE   64

NOV 6:    90 TAFLYAVSSAALTHTLARACSAGRMERCTCDDSPGLESRQAWQWGVCGDNLKYSTKFLWN  149
             |||+||+|||  + |  + ||||  +|  || ||++  |||   + +|| | ||+ +    |
Sbjct:    65 TAFLYAVSSAALTHTLARACSAGRMERCTCDDSPGLESRQAWQWGNCGDNLKYSTKFLSN  124

NOV 6:   150 FLGSK-RGNKDLRARADAHNTHVGIKAVKSGLRTTCKCHGVSGSCAVRTCWKQLSPFRET  208
             |+ ++ |      ||| + ||     | ||| ++ ||||||||||||+|+||| ||   ||
Sbjct:   125 FVDARERRGSDARALMNLHNNEAGRLAVKKTMKRECKCHGVSGSCSVKTCWLQLPEFREI  184

NOV 6:   209 GQVLKLRYDSAVKVSSATNEALGRLELWAPARQGSLTKGLAPRSGDLVYMEDSPSFC--R  266
             |   || +|| |+ |           +         | + ||||+| || ||
Sbjct:   185 GDYLKEKYDGASEV-VLDKRGTRGLVPANRDFK------PPTNTDLVYLESSPDFCEKN  236

NOV 6:   267 PSKYSPGTAGRVCSREA----SCSSLCCGRGYDTQSRLVAFSCHCQVQWCCYVECQQCVQ  322
             |    ||  ||||++ +     | ||||||||+|+     |+|+  ||||+|++| +
Sbjct:   237 PKTGSLGTQGRVCNKTSKGLDGCDLLCCGRGYNTEHVEVVERCNCKFHWCCYVKCKQCRE  296
```

TABLE 7F-continued

Domain Analysis of NOV7

```
NOV 6:  323 EELVYTCK 330
            +|||
Sbjct:  297 RVEKHTCK 304
```

Wnt proteins constitute a large family of molecules involved in cell proliferation, cell differentiation and embryonic patterning. They are known to interact with the Frizzled family of receptors to activate two main intracellular signaling pathways regulating intracellular calcium levels and gene transcription. Early studies on Wnts implicated them in cell proliferation and tumorigenesis, which have been borne out by recent work using transgenic and null mutant mice. Wnts are involved in processes involved in mammary gland development and cancer. Recent studies have demonstrated that these molecules are critical to organogenesis of several systems, such as the kidney and brain. Wnts regulate the early development, i.e. neural induction, and their role persists in later stages of development as well as in the mature organ. An example of this is seen in the brain, where the loss of certain Wnts leads to the absence of critical regions of the brain, e.g. the hippocampus, involved in learning and memory, or the cerebellum, involved in motor function. Wnts have also been implicated in the genesis of degenerative diseases such as Alzheimer's disease. The protein encoded by the novel gene described herein may therefore play a role in cellular proliferation, differentiation, dysregulation, organogenesis and disease processes such as cancer, developmental defects etc.

A partial sequence corresponding to this novel protein, with homology to the chicken Wnt-14, has been deposited in GenBank with the nomenclature Wnt-15.

Alzheimer's disease (AD) is a neurodegenerative disease with progressive dementia accompanied by three main structural changes in the brain: diffuse loss of neurons; intracellular protein deposits termed neurofibrillary tangles (NFT) and extracellular protein deposits termed amyloid or senile plaques, surrounded by dystrophic neurites. Two major hypotheses have been proposed in order to explain the molecular hallmarks of the disease: The 'amyloid cascade' hypothesis and the 'neuronal cytoskeletal degeneration' hypothesis. While the former is supported by genetic studies of the early-onset familial forms of AD (FAD), the latter revolves around the observation in vivo that cytoskeletal changes—including the abnormal phosphorylation state of the microtubule associated protein tau—may precede the deposition of senile plaques. Recent studies have suggested that the trafficking process of membrane associated proteins is modulated by the FAD-linked presenilin (PS) proteins, and that amyloid beta-peptide deposition may be initiated intracellularly, through the secretory pathway. Current hypotheses concerning presenilin function are based upon its cellular localization and its putative interaction as macromolecular complexes with the cell-adhesion/signaling beta-catenin molecule and the glycogen synthase kinase 3beta (GSK-3beta) enzyme. Developmental studies have shown that PS proteins function as components in the Notch signal transduction cascade and that beta-catenin and GSK-3beta are transducers of the Wnt signaling pathway. Both pathways are thought to have an important role in brain development, and they have been connected through Dishevelled (Dvl) protein, a known transducer of the Wnt pathway.

Members of the vertebrate Wnt family have been subdivided into two functional classes according to their biological activities. Some Wnts signal through the canonical Wnt-1/wingless pathway by stabilizing cytoplasmic beta-catenin. By contrast other Wnts stimulate intracellular Ca2+ release and activate two kinases, CamKII and PKC, in a G-protein-dependent manner. Moreover, putative Wnt receptors belonging to the Frizzled gene family have been identified that preferentially couple to the two prospective pathways in the absence of ectopic Wnt ligand and that might account for the signaling specificity of the Wnt pathways. As Ca2+ release was the first described feature of the noncanonical pathway, and as Ca2+ probably plays a key role in the activation of CamKII and PKC, Kuhl M, et al., (*Trends Genet* 2000 July;16(7):279–83) have named this Wnt pathway the Wnt/Ca2+ pathway.

Many constituents of Wnt signaling pathways are expressed in the developing and mature nervous systems. Recent work has shown that Wnt signaling controls initial formation of the neural plate and many subsequent patterning decisions in the embryonic nervous system, including formation of the neural crest. Wnt signaling continues to be important at later stages of development. Wnts have been shown to regulate the anatomy of the neuronal cytoskeleton and the differentiation of synapses in the cerebellum. Wnt signaling has been demonstrated to regulate apoptosis and may participate in degenerative processes leading to cell death in the aging brain.

Recent genetic studies have shown that the signalling factor Wnt3a is required for formation of the hippocampus; the developmental consequences of Wnt signalling in the hippocampus are mediated by multiple HMG-box transcription factors, with LEF-1 being required just for formation of the dentate gyrus.

Wnt-1 was first identified as a protooncogene activated by viral insertion in mouse mammary tumors. Transgenic expression of this gene using a mouse mammary tumor virus LTR enhancer causes extensive ductal hyperplasia early in life and mammary adenocarcinomas in approximately 50% of the female transgenic (TG) mice by 6 months of age. Metastasis to the lung and proximal lymph nodes is rare at the time tumors are detected but frequent after the removal of the primary neoplasm. The potent mitogenic effect mediated by Wnt-1 expression does not require estrogen stimulation; tumors form after an increased latency in estrogen receptor alpha-null mice. Several genetic lesions, including inactivation of p53 and over-expression of Fgf-3, collaborate with Wnt-1 in leading to mammary tumors, but loss of Sky and inactivation of one allele of Rb do not affect the rate of tumor formation in Wnt-1 TG mice.

Communication between cells is often mediated by secreted signaling molecules that bind cell surface receptors and modulate the activity of specific intracellular effectors. The Wnt family of secreted glycoproteins is one group of signaling molecules that has been shown to control a variety of developmental processes including cell fate specification, cell proliferation, cell polarity and cell migration. In addition, mis-regulation of Wnt signaling can cause developmental defects and is implicated in the genesis of several human cancers. The importance of Wnt signaling in development and in clinical pathologies is underscored by the large number of primary research papers examining various aspects of Wnt signaling that have been published in the past several years.

Reproductive tract development and function is regulated by circulating steroid hormones. In the mammalian female reproductive tract, estrogenic compounds direct many aspects of cytodifferentiation including uterine gland formation, smooth muscle morphology, and epithelial differentiation. While it is clear that these hormones act through their cognate nuclear receptors, it is less clear what signaling events follow hormonal stimulation that govern cytodifferentiation. Recent advances in molecular embryology and cancer cell biology have identified the Wnt family of secreted signaling molecules. Discussed here are recent advances that point to a definitive role during uterine development and adult function for one member of the Wnt gene family, Wnt-7a. In addition, recent data is reviewed that implicates Wnt-7a deregulation in response to pre-natal exposure to the synthetic estrogenic compound, DES. These advances point to an important role for the Wnt gene family in various reproductive tract pathologies including cancer.

Holoprosencephaly (HPE) is the most common developmental defect of the forebrain in humans. Several distinct human genes for holoprosencephaly have now been identified. They include Sonic hedgehog (SHH), ZIC2, and SIX3. Many additional genes involved in forebrain development are rapidly being cloned and characterized in model vertebrate organisms. These include Patched (Ptc), Smoothened (Smo), cubitus interuptus (ci)/Gli, wingless (wg/Wnt, decapentaplegic (dpp)/BMP, Hedgehog interacting protein (Hip), nodal, Smads, One-eyed pinhead (Oep), and TG-Interacting Factor (TGIF). However, further analysis is needed before their roles in HPE can be established.

Female reproductive hormones control mammary gland morphogenesis. In the absence of the progesterone receptor (PR) from the mammary epithelium, ductal side-branching fails to occur. Brisken C, et al. (*Genes Dev* 2000 Mar. 15;14(6):650–4) overcame this defect by ectopic expression of the protooncogene Wnt-1. Transplantation of mammary epithelia from Wnt-4(−)/(−) mice shows that Wnt-4 has an essential role in side-branching early in pregnancy. PR and Wnt-4 mRNAs colocalize to the luminal compartment of the ductal epithelium. Progesterone induces Wnt-4 in mammary epithelial cells and is required for increased Wnt-4 expression during pregnancy. Thus, Wnt signaling is essential in mediating progesterone function during mammary gland morphogenesis.

Synapse formation requires changes in cell morphology and the upregulation and localization of synaptic proteins. In the cerebellum, mossy fibers undergo extensive remodeling as they contact several granule cells and form complex, multisynaptic glomerular rosettes. Hall AC, et al., (*Cell* 2000 Mar. 3;100(5):525–35) showed that granule cells secrete factors that induce axon and growth cone remodeling in mossy fibers. This effect is blocked by the WNT antagonist, sFRP-1, and mimicked by WNT-7a, which is expressed by granule cells. WNT-7a also induces synapsin I clustering at remodeled areas of mossy fibers, a preliminary step in synaptogenesis. Wnt-7a mutant mice show a delay in the morphological maturation of glomerular rosettes and in the accumulation of synapsin I. We propose that WNT-7a can function as a synaptogenic factor.

Estrogens have important functions in mammary gland development and carcinogenesis. To better define these roles, Bocchinfuso W P, et al., (*Cancer Res* 1999 Apr. 15;59(8):1869–76) have used two previously characterized lines of genetically altered mice: estrogen receptor-alpha (ER alpha) knockout (ERKO) mice, which lack the gene encoding ER alpha, and mouse mammary virus tumor (MMTV)-Wnt-1 transgenic mice (Wnt-1 TG), which develop mammary hyperplasia and neoplasia due to ectopic production of the Wnt-1 secretory glycoprotein. Bocchinfuso W P, et al. have crossed these lines to ascertain the effects of ER alpha deficiency on mammary gland development and carcinogenesis in mice expressing the Wnt-1 transgene. Introduction of the Wnt-1 transgene into the ERKO background stimulates proliferation of alveolar-like epithelium, indicating that Wnt-1 protein can promote mitogenesis in the absence of an ER alpha-mediated response. The hyperplastic glandular tissue remains confined to the nipple region, implying that the requirement for ER alpha in ductal expansion is not overcome by ectopic Wnt-1. Tumors were detected in virgin ERKO females expressing the Wnt-1 transgene at an average age (48 weeks) that is twice that seen in virgin Wnt-1 TG mice (24 weeks) competent to produce ER alpha. Prepubertal ovariectomy of Wnt-1 TG mice also extended tumor latency to 42 weeks. However, pregnancy did not appear to accelerate the appearance of tumors in Wnt-1 TG mice, and tumor growth rates were not measurably affected by late ovariectomy. Small hyperplastic mammary glands were observed in Wnt-1 TG males, regardless of ER alpha gene status; the glands were similar in appearance to those found in ERKO/Wnt-1 TG females. Mammary tumors also occurred in Wnt-1 TG males; latency tended to be longer in the heterozygous ER alpha and ERKO males (86 to 100 weeks) than in wild-type ER alpha mice (ca. 75 weeks). Bocchinfuso W P, et al. concluded that ectopic expression of the Wnt-1 proto-oncogene can induce mammary hyperplasia and tumorigenesis in the absence of ER alpha in female and male mice. The delayed time of tumor appearance may depend on the number of cells at risk of secondary events in the hyperplastic glands, on the carcinogenesis-promoting effects of ER alpha signaling, or on both.

Wnt-1 and Wnt-3a proto-oncogenes have been implicated in the development of midbrain and hindbrain structures. Evidence for such a role has been derived from in situ hybridization studies showing Wnt-1 and -3a expression in developing cranial and spinal cord regions and from studies of mutant mice whose Wnt-1 genes have undergone targeted disruption by homologous recombination. Wnt-1 null mutants exhibit cranial defects but no spinal cord abnormalities, despite expression of the gene in these regions. The absence of spinal cord abnormalities is thought to be due to a functional compensation of the Wnt-1 deficiency by related genes, a problem that has complicated the analysis of null mutants of other developmental genes as well. Augustine K, et al., (*Dev Genet* 1993;14(6):500–20) describe the attenuation of Wnt-1 expression using antisense oligonucleotide inhibition in mouse embryos grown in culture. Augustine K, et al. induced similar mid- and hindbrain abnormalities as those seen in the Wnt-1 null mutant mice. Attenuation of Wnt-1 expression was also associated with cardiomegaly resulting in hemostasis. These findings are consistent with the possibility that a subset of Wnt-1 expressing cells include neural crest cells known to contribute to septation of the truncus arteriosus and to formation of the visceral arches. Antisense knockout of Wnt-3a, a gene structurally related to Wnt-1, targeted the forebrain and midbrain region, which were hypoplastic and failed to expand, and the spinal cord, which exhibited lateral outpocketings at the level of the forelimb buds. Dual antisense knockouts of Wnt-1 and Wnt-3a targeted all brain regions leading to incomplete closure of the cranial neural folds, and an increase in the number and severity of outpocketings along the spinal cord, suggesting that these genes complement one another to produce normal patterning of the spinal cord. The short time required to assess the mutant phenotype (2 days) and the need for limited sequence information of the target gene (20–25 nucleotides) make this antisense oligonucleotide/whole embryo culture system ideal for testing the importance of specific genes and their interactions in murine embryonic development.

Wnt-1 (previously known as int-1) is a proto-oncogene induced by the integration of the mouse mammary tumor virus. It is thought to play a role in intercellular communication and seems to be a signalling molecule important in the development of the central nervous system (CNS). The sequence of wnt-1 is highly conserved in mammals, fish, and amphibians. Wnt-1 is a member of a large family of related proteins that are all thought to be developmental regulators. These proteins are known as wnt-2 (also known as irp), wnt-3 up to wnt-15. At least four members of this family are present in *Drosophila*. One of them, wingless (wg), is implicated in segmentation polarity. All these proteins share the following features characteristics of secretory proteins, a signal peptide, several potential N-glycosylation sites and 22 conserved cysteines that are probably involved in disulfide bonds. The Wnt proteins seem to adhere to the plasma membrane of the secreting cells and are therefore likely tosignal over only few cell diameters.

The disclosed NOV7 nucleic acid of the invention encoding a Wnt-15-like protein includes the nucleic acid whose sequence is provided in Table 7A or a fragment thereof. The invention also includes a mutant or variant nucleic acid any of whose bases may be changed from the corresponding base shown in Table 7A while still encoding a protein that maintains its Wnt-15-like activities and physiological functions, or a fragment of such a nucleic acid. The invention further includes nucleic acids whose sequences are complementary to those just described, including nucleic acid fragments that are complementary to any of the nucleic acids just described. The invention additionally includes nucleic acids or nucleic acid fragments, or complements thereto, whose structures include chemical modifications. Such modifications include, by way of nonlimiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject. In the mutant or variant nucleic acids, and their complements, up to about 32 percent of the bases may be so changed.

The disclosed NOV7 protein of the invention includes the Wnt-15-like protein whose sequence is provided in Table 7B. The invention also includes a mutant or variant protein any of whose residues may be changed from the corresponding residue shown in Table 7B while still encoding a protein that maintains its Wnt-15-like activities and physiological functions, or a functional fragment thereof. In the mutant or variant protein, up to about 38 percent of the residues may be so changed.

The above defined information for this invention suggests that these Wnt-15-like proteins (NOV7) may function as a member of a "Wnt-15 family". Therefore, the NOV7 nucleic acids and proteins identified here may be useful in potential therapeutic applications implicated in (but not limited to) various pathologies and disorders as indicated below. The potential therapeutic applications for this invention include, but are not limited to: protein therapeutic, small molecule drug target, antibody target (therapeutic, diagnostic, drug targeting/cytotoxic antibody), diagnostic and/or prognostic marker, gene therapy (gene delivery/gene ablation), research tools, tissue regeneration in vivo and in vitro of all tissues and cell types composing (but not limited to) those defined here.

The nucleic acids and proteins of NOV7 are useful in Von Hippel-Lindau (VHL) syndrome, Alzheimer's disease, stroke, tuberous sclerosis, hypercalceimia, Parkinson's disease, Huntington's disease, cerebral palsy, epilepsy, Lesch-Nyhan syndrome, multiple sclerosis, ataxia-telangiectasia, leukodystrophies, behavioral disorders, addiction, anxiety, pain, neurodegeneration, cancer, developmental defects, and/or other pathologies and disorders. The novel NOV7 nucleic acid encoding NOV7 protein, or fragments thereof, may further be useful in diagnostic applications, wherein the presence or amount of the nucleic acid or the protein are to be assessed. These materials are further useful in the generation of antibodies that bind immunospecifically to the novel substances of the invention for use in therapeutic or diagnostic methods.

NOV7 nucleic acids and polypeptides are further useful in the generation of antibodies that bind immunospecifically to the novel substances of the invention for use in therapeutic or diagnostic methods. These antibodies may be generated according to methods known in the art, using prediction from hydrophobicity charts, as described in the "Anti-NOVX Antibodies" section below. For example the disclosed NOV7 protein have multiple hydrophilic regions, each of which can be used as an immunogen. In one embodiment, contemplated NOV7 epitope is from about amino acids 25 to 60. In other embodiments, NOV7 epitope is from about amino acids 65 to 80, from about amino acids 110 to 140, from about amino acids 145 to 180, from about amino acids 190 to 220, from about amino acids 230 to 270, or from about amino acids 280 to 290. This novel protein also has value in development of powerful assay system for functional analysis of various human disorders, which will help in understanding of pathology of the disease and development of new drug targets for various disorders.

NOV8

A disclosed NOV8 nucleic acid of 1085 nucleotides (also referred to 88091010_EXT) encoding a novel Wnt-14-like protein is shown in Table 8A. An open reading frame was identified beginning with an ATG initiation codon at nucleotides 13–15 and ending with a TGA codon at nucleotides 1078–1080. In Table 8A, the 5' and 3' untranslated regions are underlined and the start and stop codons are in bold letters.

TABLE 8A

NOV8 Nucleotide Sequence (SEQ ID NO:21)
TAGTGAGCCGAGATGGCACTACTATATTCCAGCTTGGGTGTGGTTGTGTGCACCTGTAGTCCTAGTTACTT

TGGACTGACGGGCAGCGAGCCCCTGACCATCCTCCCGCTGACCCTGGAGCCAGAGGCGGCTGCCCAGGCGC

ACTACAAGGCCTGCGACCGGCTGAAGCTGGAGCGGAAGCAGCGGCGCATGTGCCGCCGGGACCCGGGCGTG

GCAGAGACGCTGGTGGAGGCCGTGAGCATGAGTGCGCTCGAGTGCCAGTTCCAGTTCCGCTTTGAGCGCTG

GAACTGCACGCTGGAGGGCCGCTACCGGGCCAGCCTGCTCAAGCGAGGTTTCAAGGAGACTGCCTTCCTCT

ATGCCATCTCCTCGGCTGGCCTGACGCACGCACTGGCCAAGGCGTGCAGCGCGGGCCGCATGGAGCGCTGT

ACCTGCGATGAGGCACCCGACCTGGAGAACCGTGAGGGCTGGAAGTGGGGTGGCTGTAGCGAGGACATCGA

GTTTGGTGGGATGGTGTCTCGGGAGTTCGCCGACGCCCGGGAGAACCGGCCAGATGCCCGCTCAGCCATGA

ACCGCCACAACAACGAGGCTGGGCGCCAGGTGATCAAGGCTGGGGTGGAGACCACCTGCAAGTGCCACGGC

GTGTCAGGCTCATGCACGGTGCGGACCTGCTGGCGGCAGTTGGCGCCTTTCCATGAGGTGGGCAAGCATCT

GAAGCACAAGTATGAGTCGGCACTCAAGGTGGGCAGCACCACCAATGAAGCTGCCGGCGAGGCAGGTGCCA

TCTCCCCACCACGGGGCCGTGCCTCGGGGGCAGGTGGCAGCGACCCGCTGCCCCGCACTCCAGAGCTGGTG

CACCTGGATGACTCGCCTAGCTTCTGCCTGGCTGGCCGCTTCTCCCCGGGCACCGCTGGCCGTAGGTGCCA

CCGTGAGAAGAACTGCGAGAGCATCTGCTGTGGCCGCGGCCATAACACACAGAGCCGGGTGGTGACAAGGC

CCTGCCAGTGCCAGGTGCGTTGGTGCTGCTATGTGGAGTGCAGGCAGTGCACGCAGCGTGAGGAGGTCTAC

ACCTGCAAGGGCTGAGTTCC

The disclosed NOV8 nucleic acid sequence, localized to chromosome 1, has 560 of 725 bases (77%) identical to a gb:GENBANK-ID:AF031168|acc:AF031168.1 mRNA from *Gallus gallus* (*Gallus gallus* Wnt-14 protein (Wnt-14) mRNA, complete cds (E=5.2e$^{-115}$).

A disclosed NOV8 polypeptide (SEQ ID NO:22) encoded by SEQ ID NO:21 is 355 amino acid residues and is presented using the one-letter amino acid code in Table 8B.

Signal P, Psort and/or Hydropathy results predict that NOV8 has a signal peptide and is likely to be localized extracellularly with a certainty of 0.3700. In other embodiments, NOV8 is also likely to be localized to the enoplasmic reticulum (membrane) with a certainty of 0.1000, to the endoplasmic reticulum (lumen) with a certainty of 0.1000, or the lysosome (lumen) with a certainty of 0.1000. The most likely cleavage site for a NOV8 peptide is between amino acids 15 and 16, at: CTC-SP.

TABLE 8B

Encoded NOV8 protein sequence.

(SEQ ID NO:22)
MALLYSSLGVVVCTCSPSYFGLTGSEPLTILPLTLEPEAAAQAHYKACDRLKLERKQRRMCRRDPGVAETL

VEAVSMSALECQFQFRFERWNCTLEGRYRASLLKRGFKETAFLYAISSAGLTHALAKACSAGRMERCTCDE

APDLENREGWKWGGCSEDIEFGGMVSREFADARENRPDARSAMNRHNNEAGRQVIKAGVETTCKCHGVSGS

CTVRTCWRQLAPFHEVGKHLKHKYESALKVGSTTNEAAGEAGAISPPRGRASGAGGSDPLPRTPELVHLDD

SPSFCLAGRFSPGTAGRRCHREKNCESICCGRGHNTQSRVVTRPCQCQVRWCCYVECRQCTQREEVYTCKG

The disclosed NOV8 amino acid sequence has 270 of 354 amino acid residues (76%) identical to, and 310 of 354 amino acid residues (87%) similar to, the 354 amino acid residue ptnr:SWISSPROT-ACC:042280 protein from *Gallus gallus* (Chicken) (WNT-14 Protein Precursor ($1.2e^{-151}$).

NOV8 is expressed in at least brain. This information was derived by determining the tissue sources of the sequences that were included in the invention including but not limited to SeqCalling sources, Public EST sources, Literature sources, and/or RACE sources.

In addition, the sequence is predicted to be expressed in brain because of the expression pattern of (GENBANK-ID: gb:GENBANK-ID:AF031168|acc:AF031168.1) a closely related [*Gallus gallus* Wnt-14 protein (Wnt-14) mRNA, complete cds].

NOV8 also has homology to the amino acid sequence shown in the BLASTP data listed in Table 8C.

TABLE 8C

BLAST results for NOV8

| Gene Index/ Identifier | Protein/Organism | Length (aa) | Identity (%) | Positives (%) | Expect |
|---|---|---|---|---|---|
| gi\|15082261\|ref\|NP_0 03386.1\|(NM_003395) | wingless-type MMTV integration site family, member 14 [*Homo sapiens*] | 365 | 306/340 (90%) | 321/340 (94%) | e–167 |
| gi\|3915306\|sp\|O42280 \|WN14_CHICK | WNT-14 PROTEIN PRECURSOR | 354 | 270/357 (75%) | 310/357 (86%) | e–142 |
| gi\|16303264\|dbj\|BAB7 0499.1\|(AB063483) | WNT14B [*Homo sapiens*] | 357 | 193/339 (56%) | 244/339 (71%) | e–100 |
| gi\|7106447\|ref\|NP_03 3548.1\|(NM_009522) | wingless-related MMTV integration site 3A [*Mus musculus*] | 352 | 141/311 (45%) | 179/311 (57%) | 2e–62 |
| gi\|5821261\|dbj\|BAA83 743.1\| (AB024080) | Wnt-3a [*Gallus gallus*] | 376 | 139/311 (44%) | 179/311 (56%) | 3e–62 |

The homology of these sequences is shown graphically in the ClustalW analysis shown in Table 8D.

TABLE 8D

Information for the ClustalW proteins

```
1) NOV8 (SEQ ID NO:22)
2) gi|15082261|ref|NP_003386.1| (NM_003395) wingless-type MMTV
integration site family, member 14 [Homo sapiens]
(SEQ ID NO:64)
3) gi|3915306|sp|O42280|WN14_CHICK WNT-14 PROTEIN PRECURSOR
(SEQ ID NO:63)
4) gi|16303264|dbj|BAB70499.1| (AB063483) WNT14B
[Homo sapiens] (SEQ ID NO:62)
5) gi|7106447|ref|NP_033548.1| (NM_009522) wingless-related MMTV
integration site 3A [Mus musculus] (SEQ ID NO:67)
6) gi|5821261|dbj|BAA83743.1| (AB024080) Wnt-3a
[Gallus gallus] (SEQ ID NO:68)
```

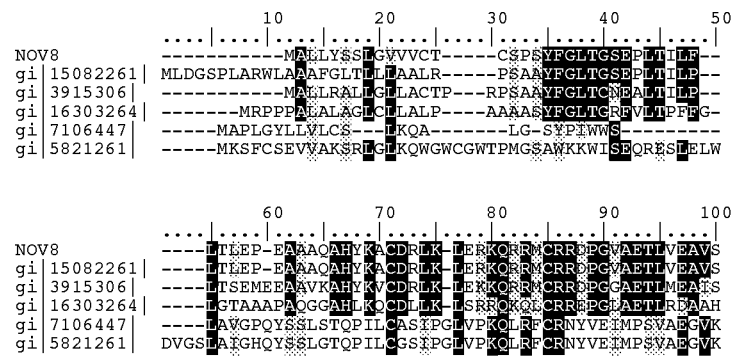

TABLE 8D-continued

Information for the ClustalW proteins

```
                 110       120       130       140       150
              ....|....|....|....|....|....|....|....|....|....|
NOV8          MSALECQFQFRFERWNCTLEGR---YRASLLKRGFKETAFLYAISSAGLT
gi|15082261|  MSALECQFQFRFERWNCTLEGR---YRASLLKRGFKETAFLYAISSAGLT
gi|3915306|   MSALECQFQFRFERWNCTLEGR---YRASLLKRGFKETAFLYAISSAGLT
gi|16303264|  LGLLECQFQFRHEWNCSLEG-----RTGLLKRGFKETAFLYAVSSAALT
gi|7106447|   AGIQECQHQFKGRRWNCTTVSNSLAIFGPVLDKATRESAFVHAIASAGVA
gi|5821261|   LGIQECQHQFKGRRWNCTTVNDSLAIFGPVLDKATRESAFVHAIASAGVA 160       170       180       190       200
              ....|....|....|....|....|....|....|....|....|....|
NOV8          HALAKACSAGRMERCTCDEAPDLENREGWKWGGCSDIEFGGMVSREFAD
gi|15082261|  HALAKACSAGRMERCTCDEAPDLENREAWCWGGCGDNLKYSSKFVKELG
gi|3915306|   HAMAKACSAGRMERCTCDEAPDLENREAWCWGGCGDNLKYSNKFVKELG
gi|16303264|  HTLAKACSAGRMERCTCDDSPGLESRQAWQWGVCGDNLKYSTKFLSNELG
gi|7106447|   FAVTRSCAEGSAAICGCSSRLQGSPGEGWKWGGCSEDIEFGGMVSREFAD
gi|5821261|   FAVTRSCAEGSATICGCDTRHKGSPGEGWKWGGCSEDVEFGSMVSREFAD 210       220       230       240       250
              ....|....|....|....|....|....|....|....|....|....|
NOV8          ARENRPDARSAMNRHNNEAGRQVIKAGVETTCKCHGVSGSCTVRTCWQL
gi|15082261|  RRSSK-DLRARVDFHNNLVGVKVIKAGVETTCKCHGVSGSCTVRTCWQL
gi|3915306|   RKPNK-DLRARVDFHNNLVGMKVIKAGVETTCKCHGVSGSCTVRTCWQL
gi|16303264|  SKRGNKDLRARADAHNTHVGIKAVKSGLRTTCKCHGVSGSCAVRTCWQL
gi|7106447|   ARENRPDARSAMNRHNNEAGRQAIASHMHLKCKCHGLSGSCEVKTCWSQ
gi|5821261|   ARENRPDARSAMNRHNNEAGRTSIELMHLKCKCHGLSGSCEVKTCWSQ 260       270       280       290       300
              ....|....|....|....|....|....|....|....|....|....|
NOV8          APFHEVGKHLKHKYESALKVGSTTNEAAGEAGAISPPRGRASGAGGSDPL
gi|15082261|  APFHEVGKHLKHKYETALKVGSTTNEAAGEAGAISPPRGRASGAGGSDPL
gi|3915306|   SPFHEIGKQLKQKYETSLKVGSTTNEATGE-GDISPPK--KSIPGHSDQI
gi|16303264|  SPFRETGQVLKLRMDSAVKVSSATNEALGRLELWAPAR--Q-GSLTKGLA
gi|7106447|   PDFRTIGDFLKDKYESASEMVVEKHRESRGWVETLRPR--Y----TYFKV
gi|5821261|   PDFRVIGDYLKDKYDSASEMVVEKHRESRGWVETLRPK--Y----NFFKA 310       320       330       340       350
              ....|....|....|....|....|....|....|....|....|....|
NOV8          PRFPELVHLDDSPSFCLAG--RFSPGTAGRRCHRLKN----CESTCCGRG
gi|15082261|  PRIPELVHLDDSPSFCLAG--RFSPGTAGRRCHRLKN----CESICCGRG
gi|3915306|   PRFTDLVYIDDSPSFCLMS--RYSPGTSGRKCYKDKN----CDSICCGRG
gi|16303264|  PRSGDLVYMEDSPSFCRPS--KYSPGTAGRVCSREAS----CSSLCCGRG
gi|7106447|   PTERDLVYYEASPNFCEPNPETGSFGTRDKTCNVSSHGIDGCDLLCCGRG
gi|5821261|   PTEKDLVYYENSPNFCEPNPETGSFGTRDKICNVTSHGIDGCOLLCCGRG 360       370       380
              ....|....|....|....|....|....|....|
NOV8          HNTQSRVVTRPQQCQVRWCCYVECRQCTQREEVYTCKG
gi|15082261|  HNTQSRVVTRPQQCQVRWCCYVECRQCTQREEVYTCKG
gi|3915306|   HNTQSRVVTRPQQCQVRWCCYVECRQCTQREEVYTCKD
gi|16303264|  YDTQSRLVAFSQHCQVQWCCYVECQCVQEELVYTCKH
gi|7106447|   HNARTERRREKQHCVFHWCCYVSCQECTRVYDVMICK-
gi|5821261|   HNTREKRKEKQHCIFHWCCYVRCQECIRVYDVMICK-
```

Tables 8E and 8F list the domain descriptions from DOMAIN analysis results against NOV8. This indicates that the NOV8 sequence has properties similar to those of other proteins known to contain this domain.

TABLE 8E

Domain Analysis of NOV8 gnl| Pfam| pfam00110, wnt, wnt family. (SEQ ID NO:104)
CD-Length = 313 residues, 99.7% aligned
Score = 313 bits (801), Expect = 1e-86

```
NOV 7:   48  CDRLK-LERKQRRMCRRDPGVAETLVEAVSMSALECQFQFRFERWNCTLEGRYRASL---  103
             |   |   |  +||++|||+|  |  ++ |    ++  ||| ||| ||||+  | |
Sbjct:    2  CRSLPGLSPRQRQLCRRNPDVMASVSEGAQLAIQECQHQFGRRWNCSTLDRLRVVFGKV  61

NOV 7:  104  LKRGFKETAFLYAISSAGLTHALAKACSAGRMERCTCDE-APDLENREGWKWGGCSEDIE  162
             ||+| +||||+|||||||+  ||+ +|||  | +| |||        +  |+||||+++|
Sbjct:   62  LKKGTRETAFVYAISSAGVAHAVTRACSEGELESCGCDYKKGPGGPQGSWQWGGCSDNVE  121

NOV 7:  163  FGGMVSREFADARENRPDARSAMNRHNNEAGRQVIKAGVETTCKCHGVSGSCTVRTCWRQ  222
             ||    ||||  ||||     ||||  || ||||||||+ +|+ +    |||||||||+++|||
Sbjct:  122  FGIRFSREFVDARERERDARSLMNLHNNEAGRKAVKSHMRRECKCHGVSGSCSMKTCWLS  181
```

TABLE 8E-continued

Domain Analysis of NOV8

```
NOV 7:   223 LAPFHEVGKHLKHKYESALKV-GSTTNEAAGEAGAISPPRGRASGAGGSDPLPRTPELVH 281
             |  |  ||  ||  ||+ |++|  +      ||  +    |       ||       ||+
Sbjct:   182 LPDFRAVGDALKDKYDGAIRVEPNKRGMGQGSAPRLVAKNPRFKPPTRSD-------LVY 234

NOV 7:   282 LDDSPSFCL--AGRFSPGTAGRRC----HREKNCESICCGRGHNTQSRVVTRPCQCQVRW 335
             |+|||  +|          |  || ||  |          ||  +||||+|||     |  |+  |
Sbjct:   235 LEDSPDYCERDRSTGSLGTQGRVCNKTSKGLDGGELLCCGRGYNTQQVERTEKCNCKFHW 294

NOV 7:   336 CCYVECRQCTQREEVYTCK 354
             ||||+| +| + ||+|||
Sbjct:   295 CCYVKCEECQEVVEVHTCK 313
```

TABLE 8F

Domain Analysis of NOV8 gnl| Smart| smart00097, WNT1, found in Wnt-1 (SEQ ID NO:105)
CD-Length = 304 residues, 98.7% aligned
Score = 292 bits (748), Expect = 2e-80

```
NOV 7:    53 LERKQRRMCRRDPGVAETLVEAVSMSALECQFQFRFERWNCTLEGRYRA--SLLKRGFKE 110
             |  |+||++||  +|  |   ++  |        |||  ||||  ||||+    |        +|++| +|
Sbjct:     5 LSRRQRQLCRANPDVMASVAEGAQEGIEECQHQFRFRRWNCSTAGLASIFGKVLRQGTRE 64

NOV 7:   111 TAFLYAISSAGLTHALAKACSAGRMERCTCDEAPDLENREGWKWGGCSEDIEFGGMVSRE 170
             |||+|||||||+ ||+ +|||  |  ++ |  ||  +           ||+|||||++|+||    |||
Sbjct:    65 TAFVYAISSAGVAHAVTRACSQGELDSCGCDYSKRGSGGRGWEWGGCSDNIDFGIGFSRE 124

NOV 7:   171 FADARENR-PDARSAMNRHNNEAGRQVIKAGVETTCKCHGVSGSCTVRTCWRQLAPFHEV 229
             |  ||||  |    |||+ ||  ||||||||  +|   ++   ||||||||||+|+|||   ||     |+
Sbjct:   125 FVDARERRGSDARALMNLHNNEAGRLAVKKTMKRECKCHGVSGSCSVKTCWLQLPEFREI 184

NOV 7:   230 GKHLKHKYESALKVGSTTNEAAGEAGAISPPRGRASGAGGSDPLPRTPELVHLDDSPSFC 289
             | +||  ||+ | +|                            |         |    +||+|+ || ||
Sbjct:   185 GDYLKEKYDGASEVVLD-----------KRGTRGLVPANRDFKPPTNTDLVYLESSPDFC 233

NOV 7:   290 LAGRF--SPGTAGRRCHREKN----CESICCGRGHNTQSRVVTRPCQCQVRWCCYVECRQ 343
                   |  ||  ||  |++         |+  +|||||+||+     |       |+   ||||+|+|
Sbjct:   234 EKNPKTGSLGTQGRVCNKTSKGLDGCDLLCCGRGYNTEHVEVVERCNCKFHWCCYVKCKQ 293

NOV 7:   344 CTQREEVYTCK 354
             | +|  | +|||
Sbjct:   294 CRERVEKHTCK 304
```

Wnt proteins constitute a large family of molecules involved in cell proliferation, cell differentiation and embryonic patterning. They are known to interact with the Frizzled family of receptors to activate two main intracellular signaling pathways regulating intracellular calcium levels and gene transcription. Early studies on Wnts implicated them in cell proliferation and tumorigenesis, which have been borne out by recent work using transgenic and null mutant mice. Wnts are involved in processes involved in mammary gland development and cancer. Recent studies have demonstrated that these molecules are critical to organogenesis of several systems, such as the kidney and brain. Wnts regulate the early development, i.e. neural induction, and their role persists in later stages of development as well as in the mature organ. An example of this is seen in the brain, where the loss of certain Wnts leads to the absence of critical regions of the brain, e.g. the hippocampus, involved in learning and memory, or the cerebellum, involved in motor function. Wnts have also been implicated in the genesis of degenerative diseases such as Alzheimer's disease. The protein encoded by the novel gene described herein may therefore play a role in cellular proliferation, differentiation, dysregulation, organogenesis and disease processes such as cancer, developmental defects etc.

Alzheimer's disease (AD) is a neurodegenerative disease with progressive dementia accompanied by three main structural changes in the brain: diffuse loss of neurons; intracellular protein deposits termed neurofibrillary tangles (NFT) and extracellular protein deposits termed amyloid or senile plaques, surrounded by dystrophic neurites. Two major hypotheses have been proposed in order to explain the molecular hallmarks of the disease: The 'amyloid cascade' hypothesis and the 'neuronal cytoskeletal degeneration' hypothesis. While the former is supported by genetic studies of the early-onset familial forms of AD (FAD), the latter revolves around the observation in vivo that cytoskeletal changes—including the abnormal phosphorylation state of the microtubule associated protein tau—may precede the deposition of senile plaques. Recent studies have suggested that the trafficking process of membrane associated proteins is modulated by the FAD-linked presenilin (PS) proteins, and that amyloid beta-peptide deposition may be initiated intracellularly, through the secretory pathway. Current hypotheses concerning presenilin function are based upon its cellular localization and its putative interaction as macromolecular complexes with the cell-adhesion/signaling beta-catenin molecule and the glycogen synthase kinase 3beta (GSK-3beta) enzyme. Developmental studies have shown that PS proteins function as components in the Notch signal transduction cascade and that beta-catenin and GSK-3beta are transducers of the Wnt signaling pathway. Both pathways are thought to have an important role in brain development, and they have been connected through Dishevelled (Dvl) protein, a known transducer of the Wnt pathway.

Members of the vertebrate Wnt family have been subdivided into two functional classes according to their biological activities. Some Wnts signal through the canonical Wnt-1/wingless pathway by stabilizing cytoplasmic beta-catenin. By contrast other Wnts stimulate intracellular Ca2+ release and activate two kinases, CamKII and PKC, in a G-protein-dependent manner. Moreover, putative Wnt receptors belonging to the Frizzled gene family have been identified that preferentially couple to the two prospective pathways in the absence of ectopic Wnt ligand and that might account for the signaling specificity of the Wnt pathways. As Ca2+ release was the first described feature of the noncanonical pathway, and as Ca2+ probably plays a key role in the activation of CamKII and PKC, Kuhl M, et al., (*Trends Genet* 2000 July ;16(7):279–83) have named this Wnt pathway the Wnt/Ca2+ pathway.

Many constituents of Wnt signaling pathways are expressed in the developing and mature nervous systems. Recent work has shown that Wnt signaling controls initial formation of the neural plate and many subsequent patterning decisions in the embryonic nervous system, including formation of the neural crest. Wnt signaling continues to be important at later stages of development. Wnts have been shown to regulate the anatomy of the neuronal cytoskeleton and the differentiation of synapses in the cerebellum. Wnt signaling has been demonstrated to regulate apoptosis and may participate in degenerative processes leading to cell death in the aging brain.

Recent genetic studies have shown that the signalling factor Wnt3a is required for formation of the hippocampus; the developmental consequences of Wnt signalling in the hippocampus are mediated by multiple HMG-box transcription factors, with LEF-1 being required just for formation of the dentate gyrus.

Wnt-1 was first identified as a protooncogene activated by viral insertion in mouse mammary tumors. Transgenic expression of this gene using a mouse mammary tumor virus LTR enhancer causes extensive ductal hyperplasia early in life and mammary adenocarcinomas in approximately 50% of the female transgenic (TG) mice by 6 months of age. Metastasis to the lung and proximal lymph nodes is rare at the time tumors are detected but frequent after the removal of the primary neoplasm. The potent mitogenic effect mediated by Wnt-1 expression does not require estrogen stimulation; tumors form after an increased latency in estrogen receptor alpha-null mice. Several genetic lesions, including inactivation of p53 and over-expression of Fgf-3, collaborate with Wnt-1 in leading to mammary tumors, but loss of Sky and inactivation of one allele of Rb do not affect the rate of tumor formation in Wnt-1 TG mice.

Communication between cells is often mediated by secreted signaling molecules that bind cell surface receptors and modulate the activity of specific intracellular effectors. The Wnt family of secreted glycoproteins is one group of signaling molecules that has been shown to control a variety of developmental processes including cell fate specification, cell proliferation, cell polarity and cell migration. In addition, mis-regulation of Wnt signaling can cause developmental defects and is implicated in the genesis of several human cancers. The importance of Wnt signaling in development and in clinical pathologies is underscored by the large number of primary research papers examining various aspects of Wnt signaling that have been published in the past several years.

Reproductive tract development and function is regulated by circulating steroid hormones. In the mammalian female reproductive tract, estrogenic compounds direct many aspects of cytodifferentiation including uterine gland formation, smooth muscle morphology, and epithelial differentiation. While it is clear that these hormones act through their cognate nuclear receptors, it is less clear what signaling events follow hormonal stimulation that govern cytodifferentiation. Recent advances in molecular embryology and cancer cell biology have identified the Wnt family of secreted signaling molecules. Discussed here are recent advances that point to a definitive role during uterine development and adult function for one member of the Wnt gene family, Wnt-7a. In addition, recent data is reviewed that implicates Wnt-7a deregulation in response to pre-natal exposure to the synthetic estrogenic compound, DES. These advances point to an important role for the Wnt gene family in various reproductive tract pathologies including cancer.

Holoprosencephaly (HPE) is the most common developmental defect of the forebrain in humans. Several distinct human genes for holoprosencephaly have now been identified. They include Sonic hedgehog (SHH), ZIC2, and SIX3. Many additional genes involved in forebrain development are rapidly being cloned and characterized in model vertebrate organisms. These include Patched (Ptc), Smoothened (Smo), cubitus interuptus (ci)/Gli, wingless (wg/Wnt, decapentaplegic (dpp)/BMP, Hedgehog interacting protein (Hip), nodal, Smads, One-eyed pinhead (Oep), and TG-Interacting Factor (TGIF). However, further analysis is needed before their roles in HPE can be established.

Female reproductive hormones control mammary gland morphogenesis. In the absence of the progesterone receptor (PR) from the mammary epithelium, ductal side-branching fails to occur. Brisken C, et al. (*Genes Dev* 2000 Mar. 15;14(6):650–4) overcame this defect by ectopic expression of the protooncogene Wnt-1. Transplantation of mammary epithelia from Wnt-4(−)/(−) mice shows that Wnt-4 has an essential role in side-branching early in pregnancy. PR and Wnt-4 mRNAs colocalize to the luminal compartment of the ductal epithelium. Progesterone induces Wnt-4 in mammary epithelial cells and is required for increased Wnt-4 expression during pregnancy. Thus, Wnt signaling is essential in mediating progesterone function during mammary gland morphogenesis.

Synapse formation requires changes in cell morphology and the upregulation and localization of synaptic proteins. In the cerebellum, mossy fibers undergo extensive remodeling as they contact several granule cells and form complex, multisynaptic glomerular rosettes. Hall A C, et al., (*Cell* 2000 Mar. 3;100(5):525–35) showed that granule cells secrete factors that induce axon and growth cone remodeling in mossy fibers. This effect is blocked by the WNT antagonist, sFRP-1, and mimicked by WNT-7a, which is expressed by granule cells. WNT-7a also induces synapsin I clustering at remodeled areas of mossy fibers, a preliminary step in synaptogenesis. Wnt-7a mutant mice show a delay in the morphological maturation of glomerular rosettes and in the accumulation of synapsin I. We propose that WNT-7a can function as a synaptogenic factor.

Estrogens have important functions in mammary gland development and carcinogenesis. To better define these roles, Bocchinfuso W P, et al., (*Cancer Res* 1999 Apr. 15;59(8):1869–76) have used two previously characterized lines of genetically altered mice: estrogen receptor-alpha (ER alpha) knockout (ERKO) mice, which lack the gene encoding ER alpha, and mouse mammary virus tumor (MMTV)-Wnt-1 transgenic mice (Wnt-1 TG), which develop mammary hyperplasia and neoplasia due to ectopic production of the Wnt-1 secretory glycoprotein. Bocchinfuso WP, et al. have crossed these lines to ascertain the effects of ER alpha deficiency on mammary gland development and carcinogenesis in mice expressing the Wnt-1 transgene. Introduction of the Wnt-1 transgene into the ERKO background stimulates proliferation of alveolar-like epithelium, indicating that Wnt-1 protein can promote mitogenesis in the absence of an ER alpha-mediated response. The hyperplastic glandular tissue remains confined to the nipple region, implying that the requirement for ER alpha in ductal expansion is not overcome by ectopic Wnt-1. Tumors were detected in virgin ERKO females expressing the Wnt-1 transgene at an average age (48 weeks) that is twice that seen in virgin Wnt-1 TG mice (24 weeks) competent to produce ER alpha. Prepubertal ovariectomy of Wnt-1 TG mice also extended tumor latency to 42 weeks. However, pregnancy did not appear to accelerate the appearance of tumors in Wnt-1 TG mice, and tumor growth rates were not measurably affected by late ovariectomy. Small hyperplastic mammary glands were observed in Wnt-1 TG males, regardless of ER alpha gene status; the glands were similar in appearance to those found in ERKO/Wnt-1 TG females. Mammary tumors also occurred in Wnt-1 TG males; latency tended to be longer in the heterozygous ER alpha and ERKO males (86 to 100 weeks) than in wild-type ER alpha mice (ca. 75 weeks). Bocchinfuso WP, et al. concluded that ectopic expression of the Wnt-1 proto-oncogene can induce mammary hyperplasia and tumorigenesis in the absence of ER alpha in female and male mice. The delayed time of tumor appearance may depend on the number of cells at risk of secondary events in the hyperplastic glands, on the carcinogenesis-promoting effects of ER alpha signaling, or on both.

Wnt-1 and Wnt-3a proto-oncogenes have been implicated in the development of midbrain and hindbrain structures. Evidence for such a role has been derived from in situ hybridization studies showing Wnt-1 and -3a expression in developing cranial and spinal cord regions and from studies of mutant mice whose Wnt-1 genes have undergone targeted disruption by homologous recombination. Wnt-1 null mutants exhibit cranial defects but no spinal cord abnormalities, despite expression of the gene in these regions. The absence of spinal cord abnormalities is thought to be due to a functional compensation of the Wnt-1 deficiency by related genes, a problem that has complicated the analysis of null mutants of other developmental genes as well. Augustine K, et al., (*Dev Genet* 1993;14(6):500–20) describe the attenuation of Wnt-1 expression using antisense oligonucleotide inhibition in mouse embryos grown in culture. Augustine K, et al. induced similar mid- and hindbrain abnormalities as those seen in the Wnt-1 null mutant mice. Attenuation of Wnt-1 expression was also associated with cardiomegaly resulting in hemostasis. These findings are consistent with the possibility that a subset of Wnt-1 expressing cells include neural crest cells known to contribute to septation of the truncus arteriosus and to formation of the visceral arches. Antisense knockout of Wnt-3a, a gene structurally related to Wnt-1, targeted the forebrain and midbrain region, which were hypoplastic and failed to expand, and the spinal cord, which exhibited lateral outpocketings at the level of the forelimb buds. Dual antisense knockouts of Wnt-1 and Wnt-3a targeted all brain regions leading to incomplete closure of the cranial neural folds, and an increase in the number and severity of outpocketings along the spinal cord, suggesting that these genes complement one another to produce normal patterning of the spinal cord. The short time required to assess the mutant phenotype (2 days) and the need for limited sequence information of the target gene (20–25 nucleotides) make this antisense oligonucleotide/whole embryo culture system ideal for testing the importance of specific genes and their interactions in murine embryonic development.

Wnt-1 (previously known as int-1) is a proto-oncogene induced by the integration of the mouse mammary tumor virus. It is thought to play a role in intercellular communication and seems to be a signalling molecule important in the development of the central nervous system (CNS). The sequence of wnt-1 is highly conserved in mammals, fish, and amphibians. Wnt-1 is a member of a large family of related proteins that are all thought to be developmental regulators. These proteins are known as wnt-2 (also known as irp), wnt-3 up to wnt-15. At least four members of this family are present in *Drosophila*. One of them, wingless (wg), is implicated in segmentation polarity. All these proteins share the following features characteristics of secretory proteins, a signal peptide, several potential N-glycosylation sites and 22 conserved cysteines that are probably involved in disulfide bonds. The Wnt proteins seem to adhere to the plasma membrane of the secreting cells and are therefore likely to signal over only few cell diameters.

The disclosed NOV8 nucleic acid of the invention encoding a Wnt-14-like protein includes the nucleic acid whose sequence is provided in Table 8A or a fragment thereof. The invention also includes a mutant or variant nucleic acid any of whose bases may be changed from the corresponding base shown in Table 8A while still encoding a protein that maintains its Wnt-14-like activities and physiological functions, or a fragment of such a nucleic acid. The invention further includes nucleic acids whose sequences are complementary to those just described, including nucleic acid fragments that are complementary to any of the nucleic acids just described. The invention additionally includes nucleic acids or nucleic acid fragments, or complements thereto, whose structures include chemical modifications. Such modifications include, by way of nonlimiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject. In the mutant or variant nucleic acids, and their complements, up to about 23 percent of the bases may be so changed.

The disclosed NOV8 protein of the invention includes the Wnt-14-like protein whose sequence is provided in Table 8B. The invention also includes a mutant or variant protein any of whose residues may be changed from the corresponding residue shown in Table 8B while still encoding a protein that maintains its Wnt-14-like activities and physiological functions, or a functional fragment thereof. In the mutant or variant protein, up to about 24 percent of the residues may be so changed.

The protein similarity information, expression pattern, and map location for the Wnt-14-like protein and nucleic acid (NOV8) disclosed herein suggest that NOV8 may have important structural and/or physiological functions characteristic of the Wnt-14-like family. Therefore, the NOV8 nucleic acids and proteins of the invention are useful in potential diagnostic and therapeutic applications. These include serving as a specific or selective nucleic acid or protein diagnostic and/or prognostic marker, wherein the presence or amount of the nucleic acid or the protein are to be assessed, as well as potential therapeutic applications such as the following: (i) a protein therapeutic, (ii) a small molecule drug target, (iii) an antibody target (therapeutic, diagnostic, drug targeting/cytotoxic antibody), (iv) a nucleic acid useful in gene therapy (gene delivery/gene ablation), and (v) a composition promoting tissue regeneration in vitro and in vivo.

The NOV8 nucleic acids and proteins of the invention are useful in potential diagnostic and therapeutic applications implicated in various diseases and disorders described below and/or other pathologies. For example, the compositions of the present invention will have efficacy for treatment of patients suffering from Von Hippel-Lindau (VHL) syndrome, Alzheimer's disease, stroke, tiberous sclerosis, hypercalceimia, Parkinson's disease, Huntington's disease, cerebral palsy, epilepsy, Lesch-Nyhan syndrome, multiple sclerosis, ataxia-telangiectasia, leukodystrophies, behavioral disorders, addiction, anxiety, pain, neurodegeneration, cancer, developmental defects, and/or other pathologies/disorders. The NOV8 nucleic acid, or fragments thereof, may further be useful in diagnostic applications, wherein the presence or amount of the nucleic acid or the protein are to be assessed.

NOV8 nucleic acids and polypeptides are further useful in the generation of antibodies that bind immunospecifically to the novel substances of the invention for use in therapeutic or diagnostic methods. These antibodies may be generated according to methods known in the art, using prediction from hydrophobicity charts, as described in the "Anti-NOVX Antibodies" section below. For example the disclosed NOV8 protein have multiple hydrophilic regions, each of which can be used as an immunogen. In one embodiment, contemplated NOV8 epitope is from about amino acids 40 to 70. In another embodiment, the comtemplated NOV8 epitope is from about amino acids 80 to 110. In further embodiments, the contemplated NOV8 epitope is from about amino acids 120 to 200, from about amino acids 220 to 245, from about amino acids 250 to 280, or from about amino acids 290 to 340. This novel protein also has value in development of powerful assay system for functional analysis of various human disorders, which will help in understanding of pathology of the disease and development of new drug targets for various disorders.

NOV9

A disclosed NOV9 nucleic acid of 2037 nucleotides (also referred to as AC069250_28_da1) encoding a beta-adrenergic receptor kinase-like protein is shown in Table 9A. An open reading frame was identified beginning with an ATG initiation codon at nucleotides 16–18 and ending with a TGA codon at nucleotides 2020–2022. A putative untranslated region upstream from the initiation codon and downstream from the termination codon is underlined in Table 9A. The start and stop codons are in bold letters. Single nucleotide polymorphism data for NOV9 is discussed in further detail in Example 3.

TABLE 9A

NOV9 nucleotide sequence.

(SEQ ID NO:23)
GCCGCCGCCGCCAAGATGGCGGACCTGGAGGCGGTGCTGGCCGACGTGAGCTACCTGATGGCCATGGAGAAG

AGCAAGGCCACGCCGGCCGCGCGCGCCAGCAAGAAGATACTGCTGCCCGAGCCCAGCATCCGCAGTGTCATG

CAGAAGTACCTGGAGGACCGGGGCGAGGTGACCTTTGAGAAGATCTTTTCCCAGAAGCTGGGGTACCTGCTC

TTCCGAGACTTCTGCCTGAACCACCTGGAGGAGGCCAGGCCCTTGGTGGAATTCTATGAGGAGATCAAGAAG

TACGAGAAGCTGGAGACGGAGGAGGAGCGTGTGGCCCGCAGCCGGGAGATCTTCGACTCATACATCATGAAG

GAGCTGCTGGCCTGCTCGCATCCCTTCTCGAAGAGTGCCACTGAGCATGTCCAAGGCCACCTGGGGAAGAAG

CAGGTGCCTCCGGATCTCTTCCAGCCATACATCGAAGAGATTTGTCAAAACCTCCGAGGGGACGTGTTCCAG

AAATTCATTGAGAGCGATAAGTTCACACGGTTTTGCCAGTGGAAGAATGTGGAGCTCAACATCCACCTGACC

ATGAATGACTTCAGCGTGCATCGCATCATTGGGCGCGGGGGCTTTGGCGAGGTCTATGGGTGCCGGAAGGCT

GACACAGGCAAGATGTACGCCATGAAGTGCCTGGACAAAAAGCGCATCAAGATGAAGCAGGGGGAGACCCTG

GCCCTGAACGAGCGCATCATGCTCTCGCTCGTCAGCACTGGGGACTGCCCATTCATTGTCTGCATGTCATAC

GCGTTCCACACGCCAGACAAGCTCAGCTTCATCCTGGACCTCATGAACGGTGGGGACCTGCACTACCACCTC

TCCCAGCACGGGGTCTTCTCAGAGGCTGACATGCGCTTCTATGCGGCCGAGATCATCCTGGGCCTGGAGCAC

ATGCACAACCGCTTCGTGGTCTACCGGGACCTGAAGCCAGCCAACATCCTTCTGGACGAGCATGGCCACGTG

CGGATCTCGGACCTGGGCCTGGCCTGTGACTTCTCCAAGAAGAAGCCCCATGCCAGCGTGGGCACCCACGGG

TACATGGCTCCGGAGGTCCTGCAGAAGGGCGTGGCCTACGACAGCAGTGCCGACTGGTTCTCTCTGGGGTGC

ATGCTCTTCAAGTTGCTGCGGGGGCACAGCCCCTTCCGGCAGCACAAGACCAAAGACAAGCATGAGATCGAC

CGCATGACGCTGACGATGGCCGTGGAGCTGCCCGACTCCTTCTCCCCTGAACTACGCTCCCTGCTGGAGGGG

TTGCTGCAGAGGGATGTCAACCGGAGATTGGGCTGCCTGGGCCGAGGGGCTCAGGAGGTGAAAGAGAGCCCC

TTTTTCCGCTCCCTGGACTGGCAGATGGTCTTCTTGCAGAAGTACCCTCCCCCGCTGATCCCCCCACGAGGG

TABLE 9A-continued

NOV9 nucleotide sequence.

GAGGTGAACGCGGCCGACGCCTTCGACATTGGCTCCTTCGATGAGGAGGACACAAAAGGAATCAAGCAGGAG

GTGGCAGAGACTGTCTTCGACACCATCAACGCTGAGACAGACCGGCTGGAGGCTCGCAAGAAAGCCAAGAAC

AAGCAGCTGGGCCATGAGGAAGACTACGCCCTGGGCAAGGACTGCATCATGCATGGCTACATGTCCAAGATG

GGCAACCCCTTCCTGACCCAGTGGCAGCGGCGGTACTTCTACCTGTTCCCCAACCGCCTCGAGTGGCGGGGC

GAGGGCGAGGCCCCGCAGAGCCTGCTGACCATGGAGGAGATCCAGTCGGTGGAGGAGACGCAGATCAAGGAG

CGCAAGTGCCTGCTCCTCAAGATCCGCGGTGGGAAACAGTTCATTTTGCAGTGCGATAGCGACCCTGAGCTG

GTGCAGTGGAAGAAGGAGCTGCGCGACGCCTACCGCGAGGCCCAGCAGCTGGTGCAGCGGGTGCCCAAGATC

AAGAACAAGCCGCGCTCGCCCGTGGTGGAGCTGAGCAAGGTGCCGCTGGTCCAGCGCGGCAGTGCCAACGGC

CTCTGACCCGCCCACCCGCCT

In a search of public sequence databases, the NOV9 nucleic acid sequence, located on chromsome 11 has 1546 of 1574 bases (98%) identical to a beta-adrenergic receptor kinase 1 mRNA from *Homo sapiens*, (GENBANK-ID: HUMBARK1A) (E=0.0). Public nucleotide databases include all GenBank databases and the GeneSeq patent database.

The disclosed NOV9 polypeptide (SEQ ID NO:24) encoded by SEQ ID NO:23 has 668 amino acid residues and is presented in Table 9B using the one-letter amino acid code. Signal P, Psort and/or Hydropathy results predict that NOV9 has no signal peptide and is likely to be localized in the nucleus with a certainty of 0.3000. In other embodiments, NOV9 may also be localized to the microbody (peroxisome) with acertainty of 0.1478, the mitrochondrial matrix (lumen) with a certainty of 0.1000 or in the lysosome (lumen) with a certainty of 0.1000.

Public amino acid databases include the GenBank databases, SwissProt, PDB and PIR.

NOV9 is expressed in at least the following tissues: adrenal gland, bone marrow, brain—amygdala, brain—cerebellum, brain—hippocampus, brain—substantia nigra, brain—thalamus, brain—whole, fetal brain, fetal kidney, fetal liver, fetal lung, heart, kidney, lymphoma—Raji, mammary gland, pancreas, pituitary gland, placenta, prostate, salivary gland, skeletal muscle, small intestine, spinal cord, spleen, stomach, testis, thyroid, trachea, uterus. This information was derived by determining the tissue sources of the sequences that were included in the invention including but not limited to SeqCalling sources, Public EST sources, Literature sources, and/or RACE sources.

In addition, the sequence is predicted to be expressed in blood leukocytes because of the expression pattern of (GENBANK-ID:gb:GENBANK-

TABLE 9B

Encoded NOV9 protein sequence.

(SEQ ID NO:24)
MADLEAVLADVSYLMAMEKSKATPAARASKKILLPEPSIRSVMQKYLEDRGEVTFEKIFSQKLGYLLFRDFC

LNHLEEARPLVEFYEEIKKYEKLETEEERVARSREIFDSYIMKELLACSHPFSKSATEHVQGHLGKKQVPPD

LFQPYIEEICQNLRGDVFQKFIESDKFTRFCQWKNVELNIHLTMNDFSVHRIIGRGGFGEVYGCRKADTGKM

YAMKCLDKKRIKMKQGETLALNERIMLSLVSTGDCPFIVCMSYAFHTPDKLSFILDLMNGGDLHYHLSQHGV

FSEADMRFYAAEIILGLEHMHNRFVVYRDLKPANILLDEHGHVRISDLGLACDFSKKKPHASVGTHGYMAPE

VLQKGVAYDSSADWFSLGCMLFKLLRGHSPFRQHKTKDKHEIDRMTLTMAVELPDSFSPELRSLLEGLLQRD

VNRRLGCLGRGAQEVKESPFFRSLDWQMVFLQKYPPPLIPPRGEVNAADAFDIGSFDEEDTKGIKQEVAETV

FDTINAETDRLEARKKAKNKQLGHEEDYALGKDCIMHGYMSKMGNPFLTQWQRRYFYLFPNRLEWRGEGEAP

QSLLTMEEIQSVEETQIKERKCLLLKIRGGKQFILQCDSDPELVQWKKELRDAYREAQQLVQRVPKMKNKPR

SPVVELSKVPLVQRGSANGL

A search of sequence databases reveals that the NOV9 amino acid sequence has 495 of 497 amino acid residues (99%) identical to, and 495 of 497 amino acid residues (99%) similar to, the 689 amino acid residue beta-adrenergic receptor kinase from *Homo sapiens* (A53791) (E=0.0).

ID:HUMBARK1A|acc:M80776.1) a closely related Human beta-adrenergic receptor kinase 1 mRNA, complete cds homolog in species *Homo sapiens*.

The disclosed NOV9 polypeptide has homology to the amino acid sequences shown in the BLASTP data listed in Table 9C.

TABLE 9C

BLAST results for NOV9

| Gene Index/ Identifier | Protein/Organism | Length (aa) | Identity (%) | Positives (%) | Expect |
|---|---|---|---|---|---|
| ptnr: pir-id:A53791 | beta-adrenergic-receptor kinase (EC 2.7.1.126) 1 - human | 689 | 495/497 (99%) | 495/497 (99%) | 0.0 |
| ptnr: SWISSPROT-ACC: P25098 | Beta-adrenergic receptor kinase 1 (EC 2.7.1.126) | 689 | 494/497 (99%) | 495/497 (99%) | 0.0 |
| ptnr: SPTREMBL-ACC: Q99LL8 | SIMILAR TO ADRENERGIC, BETA, RECEPTOR KINASE 1 - Mus musculus | 687 | 490/495 (98%), | 493/495 (99%) | 0.0 |
| ptnr: SWISSPROT-ACC: P26817 | Beta-adrenergic receptor kinase 1 | 689 | 489/497 (98%) | 493/497 (99%) | 0.0 |
| ptnr: SPTREMBL-ACC: Q99MK8 | G PROTEIN RECEPTOR KINASE 2 | 689 | 490/497 (98%) | 494/497 (99%) | 0.0 |

The homology between these and other sequences is shown graphically in the ClustalW analysis shown in Table 9D. In the ClustalW alignment of the NOV9 proteins, as well as all other ClustalW analyses herein, the black outlined amino acid residues indicate regions of conserved sequence (i.e., regions that may be required to preserve structural or functional properties), whereas non-highlighted amino acid residues are less conserved and can potentially be altered to a much broader extent without altering protein structure or function.

TABLE 9D

ClustalW Analysis of NOV9

1) NOV9 (SEQ ID NO:24)
2) ptnr:pir-id:A53791 beta-adrenergic-receptor kinase (EC 2.7.1.126) 1 (SEQ ID NO:69)
3) ptnr:SWISSPROT-ACC:P25098 Beta-adrenergic receptor kinase 1 (EC 2.7.1.126) (SEQ ID NO:70)
4) ptnr:SPTREMBL-ACC:Q99LL8 SIMILAR TO ADRENERGIC, BETA, RECEPTOR KINASE 1 - Mus musculus (Mouse) (SEQ ID NO:71)
5) 6) ptnr:SWISSPROT-ACC:P26817 Beta-adrenergic receptor kinase 1 (EC 2.7.1.126) (Beta-ARK-1) (SEQ ID NO:72)

```
NOV9    MADLEAVLADVSYLMAMEKSKATPAARASKKILLPEPSIRSVMQKYLEDRGEVTFEKIFS 60
A53791  MADLEAVLADVSYLMAMEKSKATPAARASKKILLPEPSIRSVMQKYLEDRGEVTFEKIFS 60
P25098  MADLEAVLADVSYLMAMEKSKATPAARASKKILLPEPSIRSVMQKYLEDRGEVTFEKIFS 60
Q99LL8  --DLEAVLADVSYLMAMEKSKATPAARASKKILLPEPSIRSVMQKYLEDRGEVTFEKIFS 58
P26817  MADLEAVLADVSYLMAMEKSKATPAARASKKILLPEPSIRSVMQKYLEDRGEVTFEKIFS 60

NOV9    QKLGYLLFRDFCLNHLEEARPLVEFYEEIKKYEKLETEEERVARSREIFDSYIMKELLAC 120
A53791  QKLGYLLFRDFCLNHLEEARPLVEFYEEIKKYEKLETEEERVARSREIFDSYIMKELLAC 120
P25098  QKLGYLLFRDFCLNHLEEARPLVEFYEEIKKYEKLETEEERVARSREIFDSYIMKELLAC 120
Q99LL8  QKLGYLLFRDFCLNHLEEAKPLVEFYEEIKKYEKLETEEERVRSREIFDSYIMKELLAC 118
P26817  QKLGYLLFRDFYLNHLEEAKPLVEFYEEIKYEKLETEEERVRSREIFDSYIMKELLAC 120

NOV9    SHPFSKSATEHVQGHLGKKQVPPDLFQPYIEEICQNLRGDVFQKFIESDKFTRFCQWKNV 180
A53791  SHPFSKSATEHVQGHLGKKQVPPDLFQPYIEEICQNLRGDVFQKFIESDKFTRFCQWKNV 180
P25098  SHPFSKSATEHVQGHLGKKQVPPDLFQPYIEEICQNLRGDVFQKFIESDKFTRFCQWKNV 180
Q99LL8  SHPFSKNATEHVQGHLVKKQVPPDLFQPYIEEICQNLRGDVFQKFIESDKFTRFCQWKNV 178
P26817  SHPFSKNATEHVQGHLVKKQVPPDLFQPYIEEICQNLRGDVFHKFIESDKFTRFCQWKNV 180

NOV9    ELNIHLTMNDFSVHRIIGRGGFGEVYGCRKADTGKMYAMKCLDKKRIKMKQGETLALNER 180
A53791  ELNIHLTMNDFSVHRIIGRGGFGEVYGCRKRDTGKMYAMKCLDKKRIKMKQGETLALNER 180
P25098  ELNIHLTMNDFSVHRIIGRGGFGEVYGCRKRDTGKMYAMKCLDKKRIKMKQGETLALNER 180
Q99LL8  ELNIHLTMNDFSVHRIIGRGGFGEVYGCRKADTGKMYAMKCLDKKRIKMKQGETLALNER 178
P26817  ELNIHLTMNDFSVHRIIGRGGFGEVYGCRKADTGKMYAMKCLDKKRIKMKQGETLALNER 180

NOV9    IMLSLVSTGDCPFIVCMSYAFHTPDKLSFILDLMNGGDLHYHLSQHGVFSEADMRFYAAE 300
A53791  IMLSLVSTGDCPFIVCMSYAFHTPDKLSFILDLMNGGDLHYHLSQHGVFSEADMRFYAAE 300
P25098  IMLSLVSTGDCPFIVCMSYAFHTPDKLSFILDLMNGGDLHYHLSQHGVFSEADMRFYAAE 300
Q99LL8  IMLSLVSTGDCPFIVCMSYAFHTPDKLSFILDLMNGGDLHYHLSQHGVFSEADMRFYAAE 298
P26817  IMLSLVSTGDCPFIVCMSYAFHTPDKLSFILDLMNGGDLHYHLSQHGVFSEADMRFYAAE 300
```

TABLE 9D-continued

ClustalW Analysis of NOV9

```
NOV9    IILGLEHMHNRFVVYRDLKPANILLDEHGHVRISDLGLACDFSKKKPHASVGTHGYMAPE 360
A53791  IILGLEHMHNRFVVYRDLKPANILLDEHGHVRISDLGLACDFSKKKPHASVGTHGYMAPE 360
P25098  IILGLEHMHNRFVVYRDLKPANILLDEHGHVRISDLGLACDFSKKKPHASVGTHGYMAPE 360
Q99LL8  IILGLEHMHNRFVVYRDLKPANILLDEHGHVRISDLGLACDFSKKRPHASVGTHGYMAPE 358
P26817  IILGLEHMHNRFVVYRDLKPANILLDEHGHVRISDLGLACDFSKKKPHASVGTHGYMAPE 360

NOV9    VLQKGVAYDSSADWFSLGCMLFKLLRGHSPFRQHKTKDKHEIDRMTLTMAVELPDSFSPE 420
A53791  VLQKGVAYDSSADWFSLGCMLFKLLRGHSPFRQHKTKDKHEIDRMTLTMAVELPDSFSPE 420
P25098  VLQKGVAYDSSADWFSLGCMLFKLLRGHSPFRQHKTKDKHEIDRMTLTMAVELPDSFSPE 420
Q99LL8  VLQKGVAYDSSADWFSLGCMLFKLLRGHSPFRQHKTKDKHEIDRMTLTMAVELPDSFSPE 418
P26817  VLQKGVAYDSSADWFSLGCMLFKLLRGHSPFRQHKTKDKHEIDRMTLTMAVELPDSFSPE 420

NOV9    LRSLLEGLLQRDVNRRLGCLGRGAQEVKESPFFRSLDWQMVFLQKYPPPLIPPRGEVNAA 480
A53791  LHSLLEGLLQRDVNRRLGCLGRGAQEVKESPFFRSLDWQMVFLQKYPPPLIPPRGEVNAA 480
P25098  LHSLLEGLLQRDVNRRLGCLGRGAQEVKESPFFRSLDWQMVFLQRYPPPLIPPRGEVNAA 480
Q99LL8  LRSLLEGLLQRDVNRRLGCLGRGAQEVKESPFFRSLDWQMVFLQKYPPPLIPPRGEVNAA 478
P26817  LRSLLEGLLQRDVNRRLGCLGRGAQERKESPFFRSLDWQMVFLQKYPPPLIPPRGEVNAA 480

NOV9    DAFDIGSFDEEDTKGIK---------------------QEVAETVFDTINAETDRLEARK 519
A53791  DAFDIGSFDEEDTKGIKLLDSDQELYRNFPLTISERWQQEVAETVFDTINAETDRLEARK 540
P25098  DAFDIGSFDEEDTKGIKLLDSDQELYRNFPLTISERWQQEVAETVFDTINAETDRLEARK 540
Q99LL8  DAFDIGSFDEEDTKGIKLLDSDQELYRNFPLTISERWQQEVAETVFDTINAETDRLEARK 538
P26817  DAFDIGSFDEEDTKGIKLLDSDQELYRNFPLTISERWQQEVAETVFDTINAETDRLEARK 540

NOV9    KAKNKQLGHEEDYALGKDCIMHGYMSKMGNPFLTQWQRRYFYLFPNRLEWRGEGEAPQSL 579
A53791  KAKNKQLGHEEDYALGKDCIMHGYMSKMGNPFLTQWQRRYFYLFPNRLEWRGEGEAPQSL 600
P25098  KAKNKQLGHEEDYALGKDCIMHGYMSKMGNPFLTQWQRRYFYLFPNRLEWRGEGEAPQSL 600
Q99LL8  KAKNKQLGHEEDYALGKDCIVHGYMSKMGNPFLTQWQRRYFYLFPNRLEWRGEGEAPQSL 598
P26817  KAKNKQLGHEEDYALGKDCIMHGYMSKMGNPFLTQWQRRYFYLFPNRLEWRGEDEAPQSL 600

NOV9    LTMEEIQSVEETQIKERKCLLLKIRGGKQFILQCDSDPELVQWKKELRDAYREAQQLVQR 639
A53791  LTMEEIQSVEETQIKERKCLLLKIRGGKQFILQCDSDPELVQWKKELRDAYREAQQLVQR 660
P25098  LTMEEIQSVEETQIKERKCLLLKIRGGKQFILQCDSDPELVQWKKELRDAYREAQQLVQR 660
Q99LL8  LTMEEIQSVEETQIKERKCLLLKIRGGKQFVLQCDSDPELVQWKKELRDAYREAQQLVQR 658
P26817  LTMEEIQSVEETQIKERKCLLLKIRGGKQFVLQCDSDPELVQWKKELRDAYREAQQLVQR 660

NOV9    VPKMKNKPRSPVVELSKVPLVQRGSANGL 668
A53791  VPKMKNKPRSPVVELSKVPLVQRGSANGL 689
P25098  VPKMKNKPRSPVVELSKVPLVQRGSANGL 689
Q99LL8  VPKMKNKPRSPVVELSKVPLTQRGSANGL 687
P26817  VPKMKNKPRSPVVELSKVPLTQRGSANGL 689
```

Tables 9E–9L list the domain descriptions from DOMAIN analysis results against NOV9. This indicates that the NOV9 sequence has properties similar to those of other proteins known to contain this domain.

TABLE 9E

Domain Analysis of NOV9 gnl|Smart|smart00220, S_TKc, Serine/Threonine protein kinases,
catalytic domain; Phosphotransferases. Serine or threonine-specific
kinase subfamily. (SEQ ID NO:98)
CD-Length = 256 residues, 100.0% aligned
Score = 237 bits (604), Expect = 2e-63

```
Query:  191 FSVHRIIGRGGFGEVYGCRKADTGKMYAMKCLDKKRIKMKQGETLALNERIMLSLVSTGD 250
            + +  ++|+|  ||+||   |   |||+ |+| + |+++| |+ |   | |   +|  +    |
Sbjct:    1 YELLEVLGKGAFGKVYLARDKKTGKLVAIKVIKKEKLKKKKRER-ILREIKILKKL---D 56

Query:  251 CPFIVCMSYAFHTPDKLSFILDLMNGGDLHYHLSQHGVFSEADMRFYAAEIILGLEHMHN 310
            | ||  +    |     |||   +++    ||||      | + |  || + |||| +|+   ||++|+
Sbjct:   57 HPNIVKLYDVFEDDDKLYLVMEYCEGGDLFDLLKKRGRLSEDEARFYARQILSALEYLHS 116

Query:  311 RFVVYRDLKPANILLDEHGHVRISDLGLACDFSKKKPHAS--VGTHGYMAPEVLQKGVAY 368
            + +++|||||  |||||   |||+++|  |||            + |||  |||||||| | |
Sbjct:  117 QGIIHRDLKPENILLDSDGHVKLADFGLAKQLDSGGTLLTTFVGTPEYMAPEVL-LGKGY 175

Query:  369 DSSADWFSLGCMLFKLLRGHSPFRQHKTKDK-HEIDRMTLTMAVELPDSFSPELRSLLEG 427
             +  +|||  +|++|| |   ||           +                 ||| +  |++
Sbjct:  176 GKAVDIWSLGVILYELLTGKPPFPGDDQLLALFKKIGKPPPPFPPPEWKISPEAKDLIKK 235
```

TABLE 9E-continued

Domain Analysis of NOV9

```
Query:  428  LLQRDVNRRLGCLGRGAQEVKESPFF  453
             || +|  +||       |+|  | |||
Sbjct:  236  LLVKDPEKRL-----TAEEALEHPFF  256
```

TABLE 9F

Domain Analysis of NOV9 gnl|Pfam|pfam00069, pkinase, Protein kinase domain. (SEQ ID NO:99)
CD-Length = 256 residues, 100.0% aligned
Score = 221 bits (562), Expect = 1e-58

```
Query:  191  FSVHRIIGRGGFGEVYGCRKADTGKMYAMKCLDKKRIKMKQGETLALNERIMLSLVSTGD  250
             + +  +| | ||+||  +  |||++ |+|  |  |+ +  |+     |   +|  +|
Sbjct:    1  YELGEKLGSGAFGKVYKGKHKDTGEIVAIKILKKRSLSEKKKRFL--REIQILRRLS---  55

Query:  251  CPFIVCMSYAFHTPDKLSFILDLMNGGDLHYHLSQHGVF-SEADMRFYAAEIILGLEHMH  309
             |  ||   +      |   |    +++  ||||  +| ++|+  || + +   +|+ |||++|
Sbjct:   56  HPNIVRLLGVFEEDDHLYLVMEYMEGGDLFDYLRRNGLLLSEKEAKKIALQILRGLEYLH  115

Query:  310  NRFVVYRDLKPANILLDEHGHVRISDLGLACDF---SKKKPHASVGTHGYMAPEVLQKGV  366
             +|  +|+|||||  ||||||+|  |+|+|  |||           | +|   |||   |||||||| +|
Sbjct:  116  SRGIVHRDLKPENILLDENGTVKIADFGLARKLESSSYEKLTTFVGTPEYMAPEVL-EGR  174

Query:  367  AYDSSADWFSLGCMLFKLLRGHSPFRQHKTKDKHEIDRMTLTMAVELPDSFSPELRSLLE  426
             | |   | +|||  +|++||  |  ||       ++    +  +  || + |   ||+ |++
Sbjct:  175  GYSSKVDVWSLGVILYELLTGKLPFPGIDPLEELFRIKERPRLRLPLPPNCSEELKDLIK  234

Query:  427  GLLQRDVNRRLGCLGRGAQEVKESPFF  453
             |  +|   +|         |+|+   |+|
Sbjct:  235  KCLNKDPEKRP-----TAKEILNHPWF  256
```

TABLE 9G

Domain Analysis of NOV9 gnl|Pfam|pfam00615, RGS, Regulator of G protein signaling domain. RGS
family members are GTPase-activating proteins for heterotrimeric G-
protein alpha-subunits. (SEQ ID NO:106)
CD-Length = 119 residues, 100.0% aligned
Score = 130 bits (326), Expect = 3e-31

```
Query:   54  TFEKIFSQKLGYLLFRDFCLNHLEEARPLVEFYEEIKKYEKLETEEERVARSREIFDSYI  113
             +|||+  | +| ||||+|        |  +||+ +++|||   ++| ++|||+| +|
Sbjct:    1  SFEKLLKQPIGRLLFREFLETEFSE--ENLEFWLAVEEYEKTEDPDKRPDKAREIYDEFI   58

Query:  114  MKELLACSHPFSKSATEHVQGHLGKKQVPPDLFQPYIEEICQNLRGDVFQKFIESDKFTR  173
             |          ||  +|   |||+  ||    +|||  ||   +|||   |+|+||| |||
Sbjct:   59  SPEAPKPEVNLDSELREHTQDNL-LKAPTKDLFEEAQREIYDLMRGDSFPRFLESDYFTR  117

Query:  174  FC  175
             |
Sbjct:  118  FL  119
```

TABLE 9H

Domain Analysis of NOV9 gnl|Smart|smart00219, TyrKc, Tyrosine kinase, catalytic domain;
Phosphotransferases. Tyrosine-specific kinase subfamily.
(SEQ ID NO:100)
CD-Length = 258 residues, 94.6% aligned
Score = 110 bits (275), Expect = 3e-25

```
Query:  195  RIIGRGGFGEVYGCR---KADTGKMYAMKCLDKKRIKMKQGETLALNE-RIMLSLVSTGD  250
             + +| | |||||   |           +|   | +|    |+|  ||+|  |
Sbjct:    5  KKLGEGAFGEVYKGTLKGKGGVEVEVAVKTL--KEDASEQQIEEFLREARLMRKL-----   58
```

TABLE 9H-continued

Domain Analysis of NOV9

```
Query:  251 CPFIVCMSYAFHTPDKLSFILDLMNGGDLHYHLSQHG--VFSEADMRFYAAEIILGLEHM 308
            | || +      + |  +++ ||||  +| ++       | +|+  +| +|   |+|++
Sbjct:   59 HPNIVKLLGVCTEEEPLMIVMEYMEGGDLLDYLRKNRPKELSLSDLLSFALQIARGMEYL 118

Query:  309 HNRFVVYRDLKPANILLDEHGHVRISDLGLACDFSKKKPHASVGTHG----YMAPEVLQK 364
            ++  |+|||   | |+ |+  |+|+| ||| |       +    +     +|||| |+
Sbjct:  119 ESKNFVHRDLAARNCLVGENKTVKIADFGLARDLYDDDYYRKKKSPRLPIRWMAPESLKD 178

Query:  365 GVAYDSSADWFSLGCMLFKLL-RGHSPFRQHKTKDKHEIDRMTLTMAVELPDSFSPELRS 423
            | + | +| +| | +|+++   | |+     ++ ++ +    +  | +  |+
Sbjct:  179 GK-FTSKSDVWSFGVLLWEIFTLGESPY--PGMSNEEVLEYLKKGYRLPQPPNCPDEIYD 235

Query:  424 LLEGLLQRDVNRR 436
            |+       |  |
Sbjct:  236 LMLQCWAEDPEDR 248
```

TABLE 9I

Domain Analysis of NOV9 gnl|Smart|smart00315, RGS, Regulator of G protein signalling domain; RGS family members are GTPase-activating proteins for heterotrimeric G-protein alpha-subunits. (SEQ ID NO:107)
CD-Length = 119 residues, 100.0% aligned
Score = 100 bits (248), Expect = 3e-22

```
Query:   54 TFEKIFSQKLGYLLFRDFCLNHLEEARPLVEFYEEIKKYEKLETEEERVARSREIFDSYI 113
            + |  +  +| ||||+| +     +||+ +++++| | |||| ++++|+| |+
Sbjct:    1 SLESLLRDPIGRLLFREFLESEFSE--ENLEFWLAVEEFKKAEDEEERRSKAKEIYDKYL  58

Query:  114 MKELLACSHPFSKSATEHVQGHLGKKQVPPDLFQPYIEEICQNLRGDVFQKFIESDKFTR 173
                        | ++ +|   ++ |||||     ||+ +  |   + +|+||   + |
Sbjct:   59 SPNAPKE-VNLDSDLREEIEENLKNEEPPPDLFDEAQEEVYELLEKDSYPRFLESDYYLR 117

Query:  174 FC 175
            |
Sbjct:  118 FL 119
```

TABLE 9J

Domain Analysis of NOV9 gnl|Smart|smart00233, PH, Pleckstrin homology domain.; Domain commonly found in eukaryotic signalling proteins. The domain family possesses multiple functions inlcuding the abilities to bind inositol phosphates, and various proteins. PH domains have been found to possess inserted domains (such as in PLC gamma, syntrophins) and to be inserted within other domains. Mutations in Brutons tyrosine kinase (Btk) within its PH domain cause X-linked agammaglobulinaemia (XLA) in patients. Point mutations cluster into the positively charged end of the molecule around the predicted binding site for phosphatidylinositol lipids. (SEQ ID NO:108)
CD-Length = 104 residues, 95.2% aligned
Score = 62.0 bits (149), Expect = 1e-10

```
Query:  539 IMHGYMSKMGNPFLTQWQRRYFYLFPNRLEW-----RGEGEAPQSLLTMEEIQ---SVEE 590
            |  |++ |  +   |++ |||||  |   +      + +   |+ + +   + +
Sbjct:    2 IKEGWLLKKSSGGKKSWKKRYFVLFNGVLLYYKSKKKKSSSKPKGSIPLSGCTVREAPDS  61

Query:  591 TQIKERKCLLLKIRGGKQFILQCDSDPELVQWKKELRDA 629
            |++ |  +     | +|| +|+ |  +| + |||
Sbjct:   62 DSDKKKNCFEIVTPDRKTLLLQAESEEERKEWVEALRKA 100
```

TABLE 9K

Domain Analysis of NOV9 gnl|Pfam|pfam00169, PH, PH domain, PH stands for pleckstrin homology. (SEQ ID NO:109)

TABLE 9K-continued

Domain Analysis of NOV9

CD-Length = 100 residues, 97.0% aligned
Score = 55.5 bits (132), Expect = 1e-08

```
Query:  539 IMHGYMSKMGNPFLTQWQRRYFYLFPNRLEW---RGEGEAPQSLLTMEEIQSVEETQIKE  595
                + |++ |       +|++|||+|| + | +   + +    |+ + +       +    +
Sbjct:    2 VKEGWLLKKSTVKKKRWKKRYFFLFNDVLIYYKDKKKSYEPKGSIPLSGCSVEDVPDSEF   61

Query:  596 RKCLLLKIR---GGKQFILQCDSDPELVQWKKELRDA  629
            ++       ++|    | + |||| +|+ |    | | ++ |
Sbjct:   62 KRPNCFQLRSRDGKETFILQAESEEERQDWIKAIQSA   98
```

TABLE 9L

Domain Analysis of NOV9 gnl|Smart|smart00133, S_TK_X, Extension to Ser Thr-type protein
kinases (SEQ ID NO:110)
CD-Length = 63 residues, 87.3% aligned
Score = 42.7 bits (99), Expect = 7e-05

```
Query:  454 RSLDWQMVFLQKYPPPLIPPRGEVNAADAFDIGSFDEEDTKGIKQEVAETVFDTINAETD  513
             | +||  +  ++  || +|              |  +|| |   ++      |    +|+|
Sbjct:    1 RGIDWDKLENKEIEPPFVPKVK-----SPTDTSNFDPEFT---EESPVLTPVDPPLSESD   52

Query:  514 RLE  516
            + |
Sbjct:   53 QDE   55
```

Eukaryotic protein kinases are enzymes that belong to a very extensive family of proteins which share a conserved catalytic core common with both serine/threonine and tyrosine protein kinases. There are a number of conserved regions in the catalytic domain of protein kinases. In the N-terminal extremity of the catalytic domain there is a glycine-rich stretch of residues in the vicinity of a lysine residue, which has been shown to be involved in ATP binding. In the central part of the catalytic domain there is a conserved aspartic acid residue which is important for the catalytic activity of the enzyme.

The beta-adrenergic receptor kinase (beta ARK) catalyses the phosphorylation of the activated forms of the beta 2-adrenergic receptor (beta 2AR). The interaction between receptor and kinase is independent of second messengers and appears to involve a multipoint attachment of kinase and substrate with the specificity being restricted by both the primary amino acid sequence and conformation of the substrate. Kinetic, functional and sequence information reveals that rhodopsin kinase and beta ARK are closely related, suggesting they are members of a family of G-protein-coupled receptor kinases.

The beta-adrenergic signaling cascade is an important regulator of myocardial function. Significant alterations of this pathway are associated with several cardiovascular diseases, including congestive heart failure (CHF). CHF patients share several similar features, such as reduced cardiac contractility and neurohumoral activation to compensate the impaired cardiac function. In CHF patients, the cardiac renin-angitensin (RA) system, receptors, GTP-binding proteins, and their effector molecules are inevitably exposed to chronically elevated neurohumoral stimulation. A widely recognized concept is that a chronic increase in such stimulation can desensitize target cell receptors and the post-receptor signal transducing pathway. Included in these alterations is increased activity and expression of G protein-coupled receptor kinases (GRKs), such as the beta-adrenergic receptor kinase (beta ARK1), which phosphorylate and desensitize beta-adrenergic receptors (beta ARs). A body of evidence is accumulating that suggests that GRKs, in particular beta ARK1, are critical determinants of cardiac function under normnal conditions and in disease states. Transgenic mice with myocardial-targeted alterations of GRK activity have shown profound changes in the in vivo functional performance of the heart. Included in these studies is the compelling finding that inhibition of beta ARKI activity or expression significantly enhances cardiac function and potentiates beta AR signaling in failing cardiomyocytes. An uncoupling of beta2-adrenoceptors has been attributed to an increased activity and gene expression of beta-adrenergic receptor kinase in failing myocardium, leading to phosphorylation and uncoupling of receptors. The important physiological function of GRK2 as a modulator of the efficacy of GPCR signal transduction systems is exemplified by its relevance in cardiovascular physiopathology as well as by its emerging role in the regulation of chemokine receptors.

The disclosed NOV9 nucleic acid of the invention encoding a Beta-adrenergic receptor kinase-like protein includes the nucleic acid whose sequence is provided in Table 9A or a fragment thereof. The invention also includes a mutant or variant nucleic acid any of whose bases may be changed from the corresponding base shown in Table 9A while still encoding a protein that maintains its Beta-adrenergic receptor kinase-like activities and physiological functions, or a fragment of such a nucleic acid. The invention further includes nucleic acids whose sequences are complementary to those just described, including nucleic acid fragments that are complementary to any of the nucleic acids just described. The invention additionally includes nucleic acids or nucleic acid fragments, or complements thereto, whose structures include chemical modifications. Such modifications include, by way of nonlimiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject. In the mutant or variant nucleic acids, and their complements, up to about 2 percent of the bases may be so changed.

The disclosed NOV9 protein of the invention includes the Beta-adrenergic receptor kinase-like protein whose sequence is provided in Table 9B. The invention also includes a mutant or variant protein any of whose residues may be changed from the corresponding residue shown in Table 9B while still encoding a protein that maintains its Beta-adrenergic receptor kinase-like activities and physiological functions, or a functional fragment thereof. In the mutant or variant protein, up to about 1 percent of the residues may be so changed.

The protein similarity information, expression pattern, and map location for the beta-adrenergic receptor kinase-like protein and the NOV9 proteins disclosed herein suggest that this beta-adrenergic receptor kinase may have important structural and/or physiological functions characteristic of the Ser/Thr protein kinases family. Therefore, the nucleic acids and proteins of the invention are useful in potential diagnostic and therapeutic applications and as a research tool. These include serving as a specific or selective nucleic acid or protein diagnostic and/or prognostic marker, wherein the presence or amount of the nucleic acid or the protein are to be assessed, as well as potential therapeutic applications such as the following: (i) a protein therapeutic, (ii) a small molecule drug target, (iii) an antibody target (therapeutic, diagnostic, drug targeting/cytotoxic antibody), (iv) a nucleic acid useful in gene therapy (gene delivery/gene ablation), and (v) a composition promoting tissue regeneration in vitro and in vivo (vi) biological defense weapon.

The NOV9 nucleic acids and proteins of the invention are useful in potential diagnostic and therapeutic applications implicated in various diseases and disorders described below and/or other pathologies. For example, the compositions of the present invention will have efficacy for treatment of patients suffering from heart failure, hypertension, secondary pathologies caused by heart failure and hypertension, and other diseases, disorders and conditions of the like. Additionally, the compositions of the present invention may have efficacy for treatment of patients suffering from conditions associated with the role of GRK2 in brain and in the regulation of chemokine receptors. The NOV9 nucleic acid, or fragments thereof, may further be useful in diagnostic applications, wherein the presence or amount of the nucleic acid or the protein are to be assessed.

NOV9 nucleic acids and polypeptides are further useful in the generation of antibodies that bind immunospecifically to the novel substances of the invention for use in therapeutic or diagnostic methods. These antibodies may be generated according to methods known in the art, using prediction from hydrophobicity charts, as described in the "Anti-NOVX Antibodies" section below. For example the disclosed NOV9 protein have multiple hydrophilic regions, each of which can be used as an immunogen. In one embodiment, contemplated NOV9 epitope is from about amino acids 40 to 70. In another embodiment, the comtemplated NOV9 epitope is from about amino acids 80 to 110. In further embodiments, the contemplated NOV9 epitope is from about amino acids 120 to 200, from about amino acids 220 to 245, from about amino acids 250 to 280, or from about amino acids 290 to 340. This novel protein also has value in development of powerful assay system for functional analysis of various human disorders, which will help in understanding of pathology of the disease and development of new drug targets for various disorders.

NOV10

A disclosed NOV10 nucleic acid of 3003 nucleotides (also referred to as AC058790_da25) encoding an alpha-mannosidase-like protein is shown in Table 10A. An open reading frame was identified beginning with an ATG initiation codon at nucleotides 57–59 and ending with a TAA codon at nucleotides 2946–2948. A putative untranslated region upstream from the initiation codon and downstream from the termination codon is underlined in Table 10A. The start and stop codons are in bold letters. Single nucleotide polymorphism data is included in Example 3.

TABLE 10A

NOV10 Nucleotide sequence.

(SEQ ID NO:25)

GGTATCATACTCCAGCAAGCGCACATCATCAGTGACGTCGATCACGATGCATCGTCATGGCGGCAGCGCCGTTCTTGAAG

CACTGGCGCACCACTTTTGAGCGGGTGGAGAAGTTCGTGTCCCCGATCTACTTCACCGACTGTAACCTCCGCGGCAGGCT

TTTTGGGGCCAGCTGCCCTGTGGCTGTGCTCTCCAGCTTCCTGACGCCGGAGAGACTTCCCTACCAGGAGGCAGTCCAGC

GGGACTTCCGCCCCGCGCAGGTCGGCGACAGCTTCGGACCCACATGGTGGACCTGCTGGTTCCGGGTGGAGCTGACCATC

TGTCCAGGGTTTAACCAAAGAGGGTGAGAAGACCAGCTATGTCCTGACTGACAGGCTGGGGGAAAGAGACCCCCGAAGCC

TCACTCTCTATGTGGAAGTAGCCTGCAATGGGCTCCTGGGGCCGGGAAGGGAAGCATGATTGCAGCCCCTGACCCTGAG

AAGATGTTCCAGCTGAGCCGGGCTGAGCTAGCTGTGTTCCACCGGGATGTCCACATGCTCCTGGTGGATCTGGAGCTGCT

GCTGGGCATAGCCAAGGCGCAGCAGCTGGAATGGGTGAAGAGCCGCTACCCTGGCCTGTACTCCCGCATCCAGGAGTTTG

CGTGCCGTGGGCAGTTTGTGCCTGTGGGGGGCACCTGGGTGGAGATGGATGGGAACCTGCCCAGTGGAGAGGCCATGGTG

AGGCAGTTTTTGCAGGGCCAGAACTTCTTTCTGCAGGAGTTTGGGAAGATGTGCTCTGAGTTCTGGCTGCCGGACACCTT

TGGCTACTCAGCACAGCTCCCCCAGATCATGCACGGCTGTGGCATCAGGCGCTTTCTCACCCAGAAATTGAGCTGGAATT

TGGTGAACTCCTTCCCACACCATACATTTTTCTGGGAGGGCCTGGATGGCTCCCGTGTACTGGTCCACTTCCCACCTGGC

TABLE 10A-continued

NOV10 Nucleotide sequence.

GACTCCTATGGGATGCAGGGCAGCGTGGAGGAGGTGCTGAAGACCGTGGCCAACAACCGGGACAAGGGGCGGGCCAACCA
CAGTGCCTTCCTCTTTGGCTTTGGGGATGGGGGTGGTGGCCCCACCCAGACCATGCTGGACCGCCTGAAGCGCCTGAGCA
ATACGGATGGGCTGCCCAGGGTGCAGCTATCTTCTCCAAGACAGCTCTTCTCAGCACTGGAGAGTGACTCAGAGCAGCTG
TGCACGTGGGTTGGGGAGCTCTTCTTGGAGCTGCACAATGGCACATACACCACCCATGCCCAGATCAAGAAGGGGAACCG
GGAATGTGAGCGGATCCTGCACGACGTGGAGCTGCTCAGTAGCCTGGCCCTGGCCCGCAGTGCCCAGTTCCTATACCCAG
CAGCCCAGCTGCAGCACCTCTGGAGGCTCCTTCTTCTGAACCAGTTCCATGATGTGGTGACTGGAAGCTGCATCCAGATG
GTGGCAGAGGAAGCCATGTGCCATTATGAAGACATCCGTTCCCATGGCAATACACTGCTCAGCGCTGCAGCCGCAGCCCT
GTGTGCTGGGGAGCCAGGTCCTGAGGGCCTCCTCATCGTCAACACACTGCCCTGGAAGCGGATCGAAGTGATGGCCCTGC
CCAAACCGGGCGGGGCCCACAGCCTAGCCCTGGTGACAGTGCCCAGCATGGGCTATGCTCCTGTTCCTCCCCCCACCTCA
CTGCAGCCCCTGCTGCCCCAGCAGCCTGTGTTCGTAGTGCAAGAGACTGATGGCTCCGTGACTCTGGACAATGGCATCAT
CCGAGTGAAGCTGGACCCAACTGGTCGCCTGACGTCCTTGGTCCTGGTGGCCTCTGGCAGGGAGGCCATTGCTGAGGGCG
CCGTGGGGAACCAGTTTGTGCTATTTGATGATGTCCCCTTGTACTGGGATGCATGGGACGTCATGGACTACCACCTGGAG
ACACGGAAGCCTGTGCTGGGCCAGGCAGGGACCCTGGCAGTGGGCACCGAGGGCGGCCTGCGGGGCAGCGCCTGGTTCTT
GCTACAGATCAGCCCCAACAGTCGGCTTAGCCAGGAGGTTGTGCTGGACGTTGGCTGCCCCTATGTCCGCTTCCACACCG
AGGTACACTGGCATGAGGCCCACAAGTTCCTGAAGGTGGAGTTCCCTGCTCGCGTGCGGAGTTCCCAGGCCACCTATGAG
ATCCAGTTTGGGCACCTGCAGCGACCTACCCACTACAATACCTCTTGGGACTGGGCTCGATTTGAGGTGTGGGCCCATCG
CTGGATGGATCTGTCAGAACACGGCTTTGGGCTGGCCCTGCTCAACGACTGCAAGTATGGCGCGTCAGTGCGAGGCAGCA
TCCTCAGCCTCTCGCTCTTGCGGGCGCCTAAAGCCCCGGACGCTACTGCTGACACGGGGCGCCACGAGTTCACCTATGCA
CTGATGCCGCACAAGGGCTCTTTCCAGGATGCTGGCGTTATCCAAGCTGCCTACAGCCTAAACTTCCCCCTGTTGGCTCT
GCCAGCCCCCAGCCCAGCGCCCGCCACCTCCTGGAGTGCGTTTTCCGTGTCTTCACCCGCGGTCGTATTGGAGACCGTCA
AGCAGGCGGAGAGCAGCCCCCAGCGCCGCTCGCTGGTCCTGAGGCTGTATGAGGCCCACGGCAGCCACGTGGACTGCTGG
CTGCACTTGTCGCTGCCGGTTCAGGAGGCCATCCTCTGCGATCTCTTGGAGCGACCAGACCCTGCTGGCCACTTGACTTC
GGGACAACCGCCTGAAGCTCACCTTTTCTCCCTTCCAAGTGCTGTCCCTGTTGCTCGTGCTTCAGCCTCCGCCACACTGA
GTCCCTGGGGCTGGGGTTTTGTTTGTAGAAGGCTCTGGGGACTCCTAATTTCTGCTTCCCCAGCCTAAAGCAGGGATCAG
TCTTTTCTTGTGGAATAAATCCTTGGATCGGGAAAAAAAAAAA

In a search of public sequence databases, the NOV10 nucleic acid sequence, located on chromsome 15 has 2371 of 2390 bases (99%) identical to a alpha-mannosidase mRNA from *Homo sapiens*, (GENBANK-ID: AF044414| acc: AF044414.2) (E=0.0). Public nucleotide databases include all GenBank databases and the GeneSeq patent database.

The disclosed NOV10 polypeptide (SEQ ID NO:26) encoded by SEQ ID NO:25 has 963 amino acid residues and is presented in Table 10B using the one-letter amino acid code. Signal P, Psort and/or Hydropathy results predict that NOV10 does not have a signal peptide and is likely to be localized in the peroxisome (microbody) with a certainty of 0.7480. In other embodiments, NOV10 is also likely to be localized to the mitochondrial membrane space with a certainty of 0.4539, to the mitochondrial intermembrane space with a certainty of 0.4027, or to the lysosome (lumen) with a certainty of 0.2317.

TABLE 10B

Encoded NOV10 protein sequence.

(SEQ ID NO:26)
MAAAPFLKHWRTTFERVEKEVSPIYFTDCNLRGRLFGASCPVAVLSSFLTPERLPYQEAVQRDFRPAQVGDS

FGPTWWTCWFRVELTIPEAWVGQEVHLCWESDGEGLVWRDGEPVQGLTKEGEKTSYVLTDRLGERDPRSLTL

TABLE 10B-continued

Encoded NOV10 protein sequence.

```
YVEVACNGLLGAGKGSMIAAPDPEKMFQLSRAELAVFHRDVHMLLVDLELLLGIAKAQQLEWVKSRYPGLYS
RIQEFACRGQFVPVGGTWVEMDGNLPSGEAMVRQFLQGQNFFLQEFGKMCSEFWLPDTFGYSAQLPQIMHGC
GIRRFLTQKLSWNLVNSFPHHTFFWEGLDGSRVLVHFPPGDSYGMQGSVEEVLKTVANNRDKGRANHSAFLF
GFGDGGGPTQTMLDRLKRLSNTDGLPRVQLSSPRQLFSALESDSEQLCTWVGELFLELHNGTYTTHAWIKK
GNRECERILHDVELLSSLALARSAQFLYPAAQLQHLWRLLLLNQFHDVVTGSCIQMVAEEAMCHYEDIRSHG
NTLLSAAAAALCAGEPGPEGLLIVNTLPWKRIEVMALPKPGGAHSLALVTVPSMGYAPVPPPTSLQPLLPQQ
PVFVVQETDGSVTLDNGIIRVKLDPTGRLTSLVLVASGREAIAEGAVGNQFVLFDDVPLYWDAWDVMDYHLE
TRKPVLGQAGTLAVGTEGGLRGSAWFLLQISPNSRLSQEVVLDVGCPYVRFHTEVHWHEAHKFLKVEFPARV
RSSQATYEIQFGHLQRPTHYNTSWDWARFEVWAHRWMDLSEHGFGLALLNDCKYGASVRGSILSLSLLRAPK
APDATADTGRHEFTYALMPHKGSFQDAGVIQAAYSLNFPLLALPAPSPAPATSWSAFSVSSPAVVLETVKQA
ESSPQRRSLVLRLYEAHGSHVDCWLHLSLPVQEAILCDLLERPDPAGHLTSGQPPEAHLFSLPSAVPVARAS
ASATLSPWGWGFVCRRLWGLLISASPA
```

A search of sequence databases reveals that the NOV10 amino acid sequence has 764 of 771 amino acid residues (99%) identical to, and 767 of 771 amino acid residues (99%) similar to, the 1062 amino acid residue alpha-mannosidase protein from *Homo sapiens* (Q9UL64) (E=0.0). Public amino acid databases include the GenBank databases, SwissProt, PDB and PIR.

NOV10 was derived from a pool of the following tissues: Adrenal gland, bone marrow, brain—amygdala, brain—cerebellum, brain—hippocampus, brain—substantia nigra, brain—thalamus, brain—whole, fetal brain, fetal kidney, fetal liver, fetal lung, heart, kidney, lymphoma—Raji, mammary gland, pancreas, pituitary gland, placenta, prostate, salivary gland, skeletal muscle, small intestine, spinal cord, spleen, stomach, testis, thyroid, trachea, uterus, Bone, Cervix, Chorionic Villus, Colon, Liver, Lung, Lymph node, Lymphoid tissue, Ovary, Peripheral Blood, Skin, Stomach, Tonsils, Whole Organism. Thus, it is expressed in at least some of the above tissues. This information was derived by determining the tissue sources of the sequences that were included in the invention including but not limited to Seq-Calling sources, Public EST sources, Genomic Clone sources, Literature sources, and/or RACE sources.

The disclosed NOV10 polypeptide has homology to the amino acid sequences shown in the BLASTP data listed in Table 10C.

TABLE 10C

BLAST results for NOV10

| Gene Index/ Identifier | Protein/Organism | Length (aa) | Identity (%) | Positives (%) | Expect |
|---|---|---|---|---|---|
| ptnr: SPTREMBL-ACC: Q9UL64 | ALPHA MANNOSIDASE 6A8B - *Homo sapiens* | 1062 | 763/771 (99%) | 767/771 (99%) | 0.0 |
| ptnr: SPTREMBL-ACC: Q9NTJ4 | HYPOTHETICAL 115.8 KDA PROTEIN - *Homo sapiens* | 1040 | 715/722 (99%) | 718/722 (99%) | 0.0 |
| ptnr: TREMBLNEW-ACC: AAH16253 | SIMILAR TO MANNOSIDASE, ALPHA, CLASS 2C, MEMBER 1 | 1039 | 635/730 (89%), | 692/730 (94%) | 0.0 |
| ptnr: SWISSPROT-ACC: P21139 | Alpha-mannosidase (EC 3.2.1.24) | 1040 | 625/731 (85%) | 661/731 (90%) | 0.0 |
| ptnr: SPTREMBL-ACC: Q13358 | ALPHA-MANNOSIDASE - *Homo sapiens* | 425 | 425/425 (100%) | 425/425 (100%) | 0.0 |

The homology between these and other sequences is shown graphically in the ClustalW analysis shown in Table 10D. In the ClustalW alignment of the NOV10 protein, as well as all other ClustalW analyses herein, the black outlined amino acid residues indicate regions of conserved sequence (i.e., regions that may be required to preserve structural or functional properties), whereas non-highlighted amino acid residues are less conserved and can potentially be altered to a much broader extent without altering protein structure or function.

TABLE 10D

ClustalW Analysis of NOV10

1) NOV10 (SEQ ID NO:26)
2) ptnr: ALPHA MANNOSIDASE 6A8B - Homo sapiens (SEQ ID NO:73)
3) ptnr: HYPOTHETICAL 115.8 KDA PROTEIN - Homo sapiens (SEQ ID NO:74)
4) ptnr: SIMILAR TO MANNOSIDASE, ALPHA, CLASS 2C, MEMBER 1 (SEQ ID NO:75)
5) ptnr: Alpha-mannosidase (EC 3.2.1.24) (SEQ ID NO:76)

```
NOV10     MAAAPFLKHW-RTTFERVEKF-VSPIYFTDQN-LRGRLFGASCPVAVLSSFLTP-ERLPYQEAVQRD------FRPAQVQ  70
Q9UL64    MAAAPFLKHW-RTTFERVEKF-VSPIYFTDQN-LRGRLFGASCPVAVLSSFLTP-ERLPYQEAVQRD------FRPAQVQ  70
Q9NTJ4    MAAAPALKHW-RTTLERVEKF-VSPLYFTDQN-LRGRLFGASCPVAVLSSFLTP-ERLPYQEAVQRD------FRPAQVQ  70
AAH16253  MAAAPFLKHW-RTTFERVEKF-VSPIYFTDQN-LRGRLFGDSCSVT-LSSFLTP-ERLPYEKAVQQN------FSPAQVQ  69
P21139    MAAAPFLKHWTRTTFERVEKFEVSPIYFTDQNALRGRLFGDSCPVT-LSSFLTPTERLPYEKAVQEDITTRQNFSPAQVQ  79

NOV10     D-SFGPTWWTCW-FRVELTIPEAWVGQEVHLCWE-SDGEGLVWRD-GEPVQGLTK-----EGEKTSYVI-TDRLGERDPP 140
Q9UL64    D-SFGPTWWTCW-FRVELTIPEAWVGQEVHLCWE-SDGEGLVWRD-GEPVQGLTK-----EGEKTSYVI-TDRLGERDPP 140
Q9NTJ4    D-SFGPTWWTCW-FRVELTIPEAWVGQEVHLCWE-SDGEGLVWRD-GEPVQGLTK-----EGEKTSYVI-TDRLGERDPP 140
AAH16253  D-SFGPTWWTCW-FRVELVIPEVWVGQEVHLCWE-SDGESLVWRD-GEPVQGLTK-----EGEKTSYVI-SERLGRASPP 139
P21139    DNSFGPTWWTCWPRVELVIPEVWVGKEVHLCWAESDGESLVWRDDGEPVQGLTKSNNEFEGEKTSYVISTERLGHAAPP 159

NOV10     S-LTLYVEVAQNGLLGAGKGSM-IAAPDPEKMP-QLSRAELAVF-----HRDVHMLLVD-LELLLGIAK---------- 200
Q9UL64    S-LTLYVEVAQNGLLGAGKGSM-IAAPDPEKIP-QLSRAELAVF-----HRDVHMLLVD-LELLLGIAKGLGKDNQRSFQ 211
Q9NTJ4    S-LTLYVEVAQNGLLGAGKGSM-IAAPDPEKMP-QLSRAELAVF-----HRDVHMLLVD-LELLLGIAKGLGKDNQRSFQ 211
AAH16253  S-LTLYVEVAQNGLLGAGKGSM-IAAPDPEKMP-QLSQAKLAVF-----HRDVHSLLVD-LELLLGVAKGLGEDSQRSFQ 210
P21139    SRLTLYVEVAQNGLLGAGKGSMDIAAPDPEKMPIQLSQAKLAVFFNTNAHRDVHNLLVDSLELLLGVAKG---------- 229

NOV10     ---------------------------------------------------------------------------- 200
Q9UL64    ALKTANQMVNYCDPAQPETFPVAQALASRFFGQHGGESQHTIHATGHCHIDTAWLWPFKETVRKCARSWVTAKQLMERNP 291
Q9NTJ4    ALKTANQMVNYCDPAQPETFPVAQALASRFFGQHGGESQHTIHATGHCHIDTAWLWPFKETVRKCARSWVTAKQLMERNP 291
AAH16253  ALHTANQMVNICDPAQPETKPAAKALASKFFGQHGGESQHTIHAMGHCHIDTAWLWPFKETVRKCARSWSTAYTLMEQNT 290
P21139    -------------------------------------------------------------------------- 229

NOV10     ---------CQLEWVKSRYPGLYSRIQEFACEGQFVPVGGTWVEMDGNLPSGEAMVRQFLQGQNFFLQEFGKMCSEFWLR 272
Q9UL64    EFIFACSQACQLEWVKSRYPGLYSRIQEFACEGQFVPVGGTWVEMDGNLPSGEAMVRQFLQGQNFFLQEFGKMCSEFWLR 371
Q9NTJ4    EFIFACSQACQLEWVKSRYPGLYSRIQEFACEGQFVPVGGTWVEMDGNLPSGEAMVRQFLQGQNFFLQEFGKMCSEFWLR 371
AAH16253  DFIFACSQACQLEWVKSQYPGLHARKQEFACEGQFVPVGGTWVEMDGNLPSGEAMVRQFLQGQNFFLQEFGKMCSEFWLR 370
P21139    --------TLGEDNQRSFQAALYT--------ANQMVNICDP--AQPETYPAAEALASKFTAB-----RDFGQRG------ 281

NOV10     CTFGYSAQLPQIMHGCGIRRFLTQKLSWNLVNSFPHHTFFWEGLDGSRVLVHFPPGDSYGMQGSVEEVLKTVANNRDKGR 352
Q9UL64    CTFGYSAQLPQIMHGCGIRRFLTQKLSWNLVNSFPHHTFFWEGLDGSRVLVHFPPGDSYGMQGSVEEVLKTVANNRDKGR 451
Q9NTJ4    CTFGYSAQLPQIMHGCGIRRFLTQKLSWNLVNSFPHHTFFWEGLDGSRVLVHFPPGDSYGMQGSVEEVLKTVANNRDKGR 451
AAH16253  CTFGYSAQLPQIMQGCGIKRFLTQKLSWNLVNSFPHHTFFWEGLDGSRVLVHFPPGDSYGMQGSVEEVLKTVTNNRDKGR 450
P21139    -------GESQHTIHATGHCHIIDTAELW---------------------------------P---FKETVRKCAE------ 314

NOV10     ANHSAFLFGFCDGGGGPTQTMLDRLKRLSNTDGLPRVQLSSPRQLFSALESDSEQLCTWVGELFLELHNGTYTTHAQIKK 432
Q9UL64    ANHSAFLFGFCDGGGGPTQTMLDRLKRLSNTDGLPRVQLSSPRQLFSALESDSEQLCTWVGELFLELHNGTYTTHAQIKK 531
Q9NTJ4    ANHSAFLFGFCDGGGGPTQTMLDRLKRLSNTDGLPRVQLSSPRQLFSALESDSEQLCTWVGELFLELHNGTYTTHAQIKK 531
AAH16253  TNHSGFLFGFCDGGGGPTQTMLDRLKRLSNTDGLPRVQLSSPGQLFTALERDSGQLCTWVGELFLELHNGTYTTHAQEKK 530
P21139    --------------------------------------------SWS----------TTAVKLME 325

NOV10     GNRECERILHCVELLSSLALARSAQFLYPAAQLQHLWRLLLLNQFHDVVTGSCIQMVAEEAMCHYEDIRSHGNTLLSAAA 512
Q9UL64    GNRECERILHCVELLSSLALARSAQFLYPAAQLQHLWRLLLLNQFHDVVTGSCIQMVAEEAMCHYEDIRSHGNTLLSAAA 611
Q9NTJ4    GNRECERILHCVELLSSLALARSAQFLYPAAQLQHLWRLLLLNQFHDVVTGSCIQMVAEEAMCHYEDIRSHGNTLLSAAA 611
AAH16253  GNRECEQILHCVEVLSSLALARSAQFLYPAAQLQHLWRLLLLNQFHDVVTGSCIQLVAEDAMNYEDIRSHGNPLLSAAA 610
P21139    RN---------TFPTFACSQAQTAB----STQLEWVK-----NQYP---SG----------LYAQLQEFAN------- 365

NOV10     AALCAGEPGPEGLLIVNTLPWKRIEVMALPKPGGAHSLALVTVPSMGYAPVPPPTSLQPLLPQQPVFVVQETDGSVTLDN 592
Q9UL64    AALCAGEPGPEGLLIVNTLPWKRIEVMALPKPGGAHSLALVTVPSMGYAPVPPPTSLQPLLPQQPVFVVQETDGSVTLDN 691
Q9NTJ4    AALCAGEPGPEGLLIVNTLPWKRIEVMALPKPGGAHSLALVTVPSMGYAPVPPPTSLQPLLPQQPVFVVQETDGSVTLDN 691
AAH16253  AALCAGEPGPKGLLIFNTLPWKRTEVEALPKPCGAHSLALVTVPSIGYAPAPTPTSLQPLLPQQPVFVMQETDGSVTLDN 690
P21139    ---QRG----------------------------------Q-FVPVG---------------------------- 374

NOV10     GIIRVKLDPTGRLTSLVLVASGREAIAEGAVGNQFVLFDDVPLYWDAWDVMDYHLETRKPVLGQAGTLAVGTEGGLRGSA 672
Q9UL64    GIIRVKLDPTGRLTSLVLVASGREAIAEGAVGNQFVLFDDVPLYWDAWDVMDYHLETRKPVLGQAGTLAVGTEGGLRGSA 771
Q9NTJ4    GIIRVKLDPTGRLTSLVLVASGREAIAEGAVGNQFVLFDDVPLYWDAWDVMDYHLETRKPVLGQAGTLAVGTEGGLRGSA 771
AAH16253  GIIRVRLDPTGCLTSLVLVASGREAIAEGAKGNQFVLFDDVPLYWDAWDVMDYHLETRKPVLGQAGTLAVGTEGGLRGSA 770
P21139    GLTWVEMDGN-------LPLSG-EAMVR-----QFLR----------------------------------QCQN 402

NOV10     WFLLQISENGRLSQEVVLDVGCPYVRFHTEVHWHEAHKFLKVEFPARVRSSQATYEIQFGHLQRPTHYNTSWDWARFEVW 752
Q9UL64    WFLLQISENGRLSQEVVLDVGCPYVRFHTEVHWHEAHKFLKVEFPARVRSSQATYEIQFGHLQRPTHYNTSWDWARFEVW 851
Q9NTJ4    WFLLQISENGRLSQEVVLDVGCPYVRFHTEVHWHEAHKFLKVEFPARVRSSQATYEIQFGHLQRPTHYNTSWDWARFEVW 851
AAH16253  WFLLQISENGRLSQEVVLDVGCPYVRFHTEVHWHEAHKFLKVEFPARIRSPQATYEIQFGHLQRPTHNNTSWDWARYEVW 850
P21139    FFIQEF---------------------------------------------------------- 408

NOV10     AHRWMDLSEHGFGLALLNDCKYGASVRGSILSLSLLRAPKAPDATADTGRHEFTYALMPHKGSFQDAGVIQAAYSLNFPL 832
Q9UL64    AHRWMDLSEHGFGLALLNDCKYGASVRGSILSLSLLRAPKAPDATADTGRHEFTYALMPHKGSFQDAGVIQAAYSLNFPL 931
Q9NTJ4    AHRWMDLSEHGFGLALLNDCKYGASVRGSILSLSLLRAPKAPDATADTGRHEFTYALMPHKGSFQDAGVIQAAYSLNFPL 931
AAH16253  AHRWIDLSECDFGLALLNNCKYGASVRGMVLSLSLLRAPKAPDATADMGRHEFTYALMPHKGSFQBAGVIHAAYNLNFPL 930
P21139    ---------------------------------------------------------- 408
```

TABLE 10D-continued

ClustalW Analysis of NOV10

```
NOV10    LALPAPSPAPATSWSAFSVSSPAVVLETVKQAESSPQRRSLVLRLYEAHGSHVDCWLHLSLPVQEAILCDLLERPDPAGH  912
Q9UL64   LALPAPSPAPATSWSAFSVSSPAVVLETVKQAESSPQRRSLVLRLYEAHGSHVDCWLHLSLPVQEAILCDLLERPDPAGH  101
Q9NTJ4   LALPAPSPAPATSWSAFSVSSPAVVLETVKQAESSPQRRSLVLRLYEAHGSHVDCWLHLSLPVQEAILCDLLERPDPAGH  101
AAH16253 LALPAPGPAPDTWWSAFSVSSPAVVLETIKQAERCHQHRTLVLRLYEAHGSHVDCWLHTSLPVQEATLCDLLEGRDPTGH  101
P21139   --------------------------------------------------------------------------------  408

NOV10    LTSGQPPEAHLFSLPSAVPVARASASATLSPWGWGFVCRRLWGLLISASPA-   963
Q9UL64   LTSGQPPEAHLFSLPSAVPVARASASATLSPWGWGFVCRRLWGLLISASPA-  1062
Q9NTJ4   LT---------------LRDNRLKLTFSPF---QVLS---LLIVLQPPPH   1040
AAH16253 LS---------------LQDNRLKLTFSPF---QVRS---LLIVLQSPPN   1030
P21139   --------------------------------------------------   408
```

Table 10E lists the domain description from DOMAIN analysis results against NOV10. This indicates that the NOV10 sequence has properties similar to those of other proteins known to contain this domain.

defective or malfolded proteins that are specifically retained and broken down in the ER. The degradation of oligosaccharides derived from dolichol intermediates by ER/cytosolic mannosidase explains why cats and cattle with

TABLE 10E

Domain Analysis of NOV10

| Model | Description | Score | E-value |
|---|---|---|---|
| Glyco_hydro_38 (InterPro) (SEQ ID NO:111) | Glycosyl hydrolases family 38 | 140.5 | 1e-39 |

| | | |
|---|---|---|
| Glyco_hydro_38: | | domain of 1 of 2, from 230 to 332 score 89.2, E = 5.4e-25 |
| | | *->vtGGWVMnDEAttHyedlIdQlteGHgfleenfGsdvkPkvgWsIDP |
| | | \|+\|+\|\|+ \| + +++\|++++\|++ \|+ \|+ ++\|\|   +   +\|++\|+ |
| AC058790_d | 230 | VGGTWVEMDGNLPSGEAMVRQFLQGQNFFLQEFG--KMCSEFWLPDT |
| | | 274 |
| | | |
| | | FGHSatmPyLlraqaGfdgflIqRihYadKksfaetkqleFvWRqswslt |
| | | \|\|+\|\|++\|++   +  \|+ +\|\|+\|++++++ +\|\|++++    \|+\|      \|+ |
| AC058790_d | 275 | FGYSAWLPQIM-HGCGIRRFLTQKLSWNLVNSFPHHT---FFWE---GLD |
| | | 317 |
| | | |
| | | gstdlfthmmpfysYd<-* |
| | | \|\|  +++\| +\| +\|\|+ |
| AC058790_d | 318 | GS-RVLVHFPPGDSYG 332 |
| | | |
| Glyco_hydro_38: | | domain 2 of 2, from 410 to 490: score 49.2, E = 1.7e-13 |
| | | *->pYAdepdeGkPeYWTGYFTSRPalKrldRglehlLrsaEilatglsv |
| | | ++ +\|++    \| + \|++\|++++ \|+ +\|++\|  \|+++\|+\|++++ + |
| AC058790_d | 410 | TWVGELFL---ELHNGTYTTHAQIKKGNRECERILHDVELLSSLALA |
| | | 453 |
| | | |
| | | laggskiegsyAiKleklyegleelRralaLfQHHDAiTGTakghVv<-* |
| | | +++++      +   \|\|+ \|+\|  \|+\|+\|+\|  \|+++\|+++\|+\|+ |
| AC058790_d | 454 | RS-AQFLYPA-----a----QLQHLWRLLLLNQFHDVVTGSCIQMVA 490 |

Glycosyl hydrolases are key enzymes of carbohydrate metabolism. Lysosomal alpha-mannosidase is necessary for the catabolism of N-linked carbohydrates released during glycoprotein turnover. The enzyme catalyzes the hydrolysis of terminal, non-reducing alpha-D-mannose residues in alpha-D-mannosides, and can cleave all known types of alpha-mannosidic linkages. While alpha-mannosidases were classified as enzymes that process newly formed N-glycans or degrade mature glycoproteins, two endoplasmic reticulum (ER) alpha-mannosidases with previously assigned processing roles, have important catabolic activities. The ER/cytosolic mannosidase may be involved in the degradation of dolichol intermediates that are not needed for protein glycosylation, whereas the soluble form of Man9-mannosidase is responsible for the degradation of glycans on alpha-mannosidosis store and excrete some unexpected oligosaccharides containing only one GlcNAc residue. Similarly, the action of ER/cytosolic mannosidase, followed by the action of the recently described human lysosomal alpha(1→6)-mannosidase, together explain why alpha-mannosidosis patients store and excrete large amounts of oligosaccharides that resemble biosynthetic intermediates, rather than partially degraded glycans. The relative contributions of the lysosomal and extra-lysosomal catabolic pathways can be derived by comparing the ratio of trisaccharide Man beta (1→4)GlcNAc beta (1→4)GlcNAc to disaccharide Man beta (1→4)GlcNAc accumulated in tissues from goats with beta-mannosidosis. A similar determination in human beta-mannosidosis patients is not possible because the same intermediate, Man beta (1→4)-GlcNAc is a product of both pathways. Based on inhibitor studies with pyranose and furanose analogues, alpha-mannosidases may be divided into two groups. Those in Class 1 are (1→2)-specific enzymes like Golgi mannosidase I, whereas those in Class 2, like lysosomal alpha-mannosidase, can hydrolyse (1→2), (1→3) and (1→6) linkages. A similar classification has been derived from protein sequence homologies. It is possible to speculate about their probable evolution from two primordial genes. The first would have been a Class 1 ER enzyme involved in the degradation of glycans on incompletely assembled or malfolded glycoproteins. The second would have been a Class 2 lysosomal enzyme responsible for turnover. Later, other alpha-mannosidases, with new processing or catabolic functions, would have developed from these, by loss or gain of critical insertion or retention sequences, to yield the full complement of alpha-mannosidases known today (Glycobiology 1994 October;4 (5):551–66). Defects in the lysosomal alpha-mannosidase gene cause lysosomal alpha-mannosidosis (AM), a lysosomal storage disease characterized by the accumulation of unbranched oligo-saccharide chains. Depending on the clinical findings at the age of onset, a severe infantile (type 1) and a mild juvenile (type II) form of alpha-mannosidosis are recognized. Furthermore, variability in clinical expression of the disease is seen within each type. Some of the disease features are: susceptibility to infection, vomiting, coarse features, macroglossia, flat nose, large clumsy ears, widely spaced teeth, large head, big hands and feet, tall stature, slight hepatosplenomegaly, muscular hypotonia, lumbar gibbus, radiographic skeletal abnormalities, dilated cerebral ventricles, lenticular opacities, hypogammaglobulinemia, 'storage cells' in the bone marrow, and vacuolated lymphocytes in the bone marrow and blood.

The disclosed NOV10 nucleic acid of the invention encoding a Alpha-mannosidase-like protein includes the nucleic acid whose sequence is provided in Table 10A or a fragment thereof. The invention also includes a mutant or variant nucleic acid any of whose bases may be changed from the corresponding base shown in Table 10A while still encoding a protein that maintains its Alpha-mannosidase-like activities and physiological functions, or a fragment of such a nucleic acid. The invention further includes nucleic acids whose sequences are complementary to those just described, including nucleic acid fragments that are complementary to any of the nucleic acids just described. The invention additionally includes nucleic acids or nucleic acid fragments, or complements thereto, whose structures include chemical modifications. Such modifications include, by way of nonlimiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject. In the mutant or variant nucleic acids, and their complements, up to about 2 percent of the bases may be so changed.

The disclosed NOV10 protein of the invention includes the Alpha-mannosidase-like protein whose sequence is provided in Table 10B. The invention also includes a mutant or variant protein any of whose residues may be changed from the corresponding residue shown in Table 10B while still encoding a protein that maintains its Alpha-mannosidase-like activities and physiological functions, or a functional fragment thereof. In the mutant or variant protein, up to about 1 percent of the residues may be so changed.

The protein similarity information, expression pattern, and map location for the alpha-mannosidase-like protein and the NOV10 protein disclosed herein suggest that this alpha-mannosidase-like protein may have important structural and/or physiological functions characteristic of the mannosidase protein family. Therefore, the nucleic acids and proteins of the invention are useful in potential diagnostic and therapeutic applications and as a research tool. These applications include serving as a specific or selective nucleic acid or protein diagnostic and/or prognostic marker, wherein the presence or amount of the nucleic acid or the protein are to be assessed, as well as potential therapeutic applications such as the following: (i) a protein therapeutic, (ii) a small molecule drug target, (iii) an antibody target (therapeutic, diagnostic, drug targeting/cytotoxic antibody), (iv) a nucleic acid useful in gene therapy (gene delivery/gene ablation), and (v) a composition promoting tissue regeneration in vitro and in vivo (vi) biological defense weapon.

The NOV10 nucleic acids and proteins of the invention are useful in potential diagnostic and therapeutic applications implicated in various diseases and disorders described below and/or other pathologies. For example, the compositions of the present invention will have efficacy for treatment of patients suffering from alpha-mannosidosis, beta-mannosidosis, other storage disorders, peroxisomal disorders such as zellweger syndrome, infantile refsum disease, rhizomelic chondrodysplasia (chondrodysplasia punctata, rhizomelic), and hyperpipecolic acidemia and other diseases, disorders and conditions of the like. Since mannosidoses are found not only in humans, but also in animals, the nucleic acids and proteins of the this invention may be useful in treating animals with mannosidoses or other storage diseases, and other diseases, disorders and conditions of the like. Additionally, the compositions of the present invention may have efficacy for treatment of patients suffering from conditions associated with the role of GRK2 in brain and in the regulation of chemokine receptors. The NOV10 nucleic acid, or fragments thereof, may further be useful in diagnostic applications, wherein the presence or amount of the nucleic acid or the protein are to be assessed.

NOV10 nucleic acids and polypeptides are further useful in the generation of antibodies that bind immunospecifically to the novel substances of the invention for use in therapeutic or diagnostic methods. These antibodies may be generated according to methods known in the art, using prediction from hydrophobicity charts, as described in the "Anti-NOVX Antibodies" section below. For example the disclosed NOV10 protein have multiple hydrophilic regions, each of which can be used as an immunogen. In one embodiment, contemplated NOV10 epitope is from about amino acids 5 to 20. In another embodiment, the comtemplated NOV10 epitope is from about amino acids 40 to 80. In further embodiments, the contemplated NOV10 epitope is from about amino acids 110 to 180, from about amino acids 200 to 230, from about amino acids 300 to 370, from about amino acids 375 to 450, from about amino acids 650 to 680, from about amino acids 690 to 770, from about amino acids 790 to 820, from about amino acids 850 to 880, or from about amino acids 900 to 920. This novel protein also has value in development of powerful assay system for functional analysis of various human disorders, which will help in understanding of pathology of the disease and development of new drug targets for various disorders.

NOV11

NOV11 includes three novel C1q-related factor-like proteins disclosed below. The disclosed sequences have been named NOV11a, NOV11b, and NOV11c. Single nucleotide polymorphism data is discussed below in Example 4.

NOV11a

A disclosed NOV11a nucleic acid of 805 nucleotides (also referred to as GM57107065_da1) encoding an C1q-related factor-like protein is shown in Table 11A. An open reading frame was identified beginning with an ATG initiation codon at nucleotides 83–85 and ending with a TGA codon at nucleotides 797–799. Putative untranslated regions are upstream from the initiation codon and downstream from the termination codon.

A search of sequence databases reveals that the NOV 11 a amino acid sequence has 184 of 258 amino acid residues (71%) identical to, and 198 of 258 amino acid residues (76%) similar to, the 258 amino acid residue C1q-related factor precursor protein from Homo sapiens (075973) (E=9.1 e$^{-91}$). Public amino acid databases include the GenBank databases, SwissProt, PDB and PIR.

NOV11a is specifically expressed in the following tissues: brain, heart, testis, kidney, thyroid, prostate, fetal kidney,

TABLE 11A

NOV11a nucleotide sequence.

(SEQ ID NO:27)

```
GAGTGAGGAAGATTTGCTGGCCCTGGCAGCGTCGCGGCTGAGCCGCCGCAAGAGGGTGGCGGGCGCGGCCGTCGGAGTGG

CCATGGTGCTGCTGCTGCTGGTGGCCATCCCGCTGCTGGTGCACAGCTCCCGCGGGCCAGCGCACTACGAGATGCTGGGT

CGCTGCCGCATGGTGTGCGACCCGCATGGGCCCCGTGGCCCTGGTCCGGACGGCGCGCCTGCTTCCGTGCCCCCCTTCCC

GCCAGGCGCCAAGGGAGAGGTGGGCCGGTGCGGGAAAGCAGGCCTGAGGGGGCCCCCTGGACCACCAGGTCCAAGAGGGC

CCCCAGGAGAACCCGGCAGGCCAGGCCCCCCGGGCCCTCCCGGTCCAGGTCCGGGCGGGGTGGCGCCCGCTGCCGGCTAC

GTGCCTCGCATTGCTTTCTACGCGGGCCTGCGGCGGCCCCACGAGGGTTACGAGGTGCTGCGCTTCGACGACGTGGTGAC

CAACGTGGGCAACGCCTACGAGGCAGCCAGCGGCAAGTTTACTTGCCCCATGCCAGGCGTCTACTTCTTCGCTTACCACG

TGCTCATGCGCGGCGGCGACGGCACCAGCATGTGGGCCGACCTCATGAAGAACGGACAGGTCCGGGCCAGCGCCATTGCT

CAGGACGCGGACCAGAACTACGACTACGCCAGCAACAGCGTCATTCTGCACCTGGACGTGGGCGACGAGGTCTTCATCAA

GCTGGACGGCGGGAAAGTGCACGGCGGCAACACCAACAAGTACAGCACCTTCTCCGGCTTCATCATCTACCCCGACTGAG

CCGGC
```

In a search of public sequence databases, the NOV11a nucleic acid, located on chromsome 12, has 565 of 787 bases (71%) identical to a C1q-related factor mRNA from Homo sapiens, (GENBANK-ID: AF095154) (E=9.9e$^{-68}$). Public nucleotide databases include all GenBank databases and the GeneSeq patent database.

The disclosed NOV11a polypeptide (SEQ ID NO:28) encoded by SEQ ID NO:27 has 238 amino acid residues and is presented in Table I IB using the one-letter amino acid code. Signal P, Psort and/or Hydropathy results predict that NOV11a has a signal peptide and is likely to be localized extracellularly with a certainty of 0.5374. In other embodiments, NOV11a is also likely to be localized to the microbody (peroxisome) with a certainty of 0.1111, to the endoplasmic reticulum (membrane) with a certainty of 0.1000, and to the endoplasmic reticulum (lumen) with a certainty of 0.1000. The most likely cleavage site for NOV11a is between positions 15 and 16: VHS-SR.

fetal skletal. It shows increased expression in cancer cell lines derived from the following tissue: colon, kidney, ovary, skin, brain. It is highly upregulated in IFN-gamma treated endothelial cells. This information was derived by determining the tissue sources of the sequences that were included in the invention including but not limited to Seq-Calling sources and Taqman results.

NOV11b

A disclosed NOV11b nucleic acid of 805 nucleotides (also referred to as CG54503-O$_2$) encoding a novel C1q-related factor-like protein is shown in Table 11C. An open reading frame was identified beginning with an ATG initiation codon at nucleotides 83–85 and ending with a TGA codon at nucleotides 797–799. Putative untranslated regions are underlined and are found upstream from the initiation codon and downstream from the termination codon.

TABLE 11B

Encoded NOV11a protein sequence.

(SEQ ID NO:28)

```
MVLLLLVAIPLLVHSSRGPAHYEMLGRCRMVCDPHGPRGPGPDGAPASVPPFPPGAKGEVGRCGKAGLRGPP

GPPGPRGPPGEPGRPGPPGPPGPGPGGVAPAAGYVPRIAFYAGLRRPHEGYEVLRFDDVVTNVGNAYEAASG

KFTCPMPGVYFFAYHVLMRGGDGTSMWADLMKNGQVRASAIAQDADQNYDYASNSVILHLDVGDEVFIKLDG

GKVHGGNTNKYSTFSGFIIYPD
```

TABLE 11C

NOV11b nucleotide sequence.

(SEQ ID NO:29)
GAGTGAGGAAGATTTGCTGGCCCTGGCAGCGTCGCGGCTGAGCCGCCGCAAGAGGGTGGCGGGCGCGGCCGTCGGAGTGG

CCATGGTGCTGCTGCTGCTGGTGGCCATCCCGCTGCTGGTGCACAGCTCCCGCGGGCCAGCGCACTACGAGATGCTGGGT

CGCTGCCGCATGGTGTGCGACCCGCATGGGCCCCGTGGCCCTGGTCCGGACGGCGCGCCTGCTTCCGTGCCCCCCTTCCC

GCCAGGCGCCAAGGGAGAGGTGGGCCGGCGCGGGAAAGCAGGCCTGCGGGGCCCCCTGGACCACCAGGTCCAAGAGGGC

CCCCAGGAGAACCCGGCAGGCCAGGCCCCCGGGCCCTCCCGGTCCAGGTCCGGGCGGGGTGGCGCCCGCTGCCGGCTAC

GTGCCTCGCATTGCTTTCTACGCGGGCCTGCGGCGGCCCCACGAGGGTTACGAGGTGCTGCGCTTCGACGACGTGGTGAC

CAACGTGGGCAACGCCTACGAGGCAGCCAGCGGCAAGTTTACTTGCCCCATGCCAGGCGTCTACTTCTTCGCTTACCACG

TGCTCATGCGCGGCGGCGACGGCACCAGCATGTGGGCCGACCTCATGAAGAACGGACAGGTCCGGGCCAGCGCCATTGCT

CAGGACGCGGACCAGAACTACGACTACGCCAGCAACAGCGTCATTCTGCACCTGGACGTGGGCGACGAGGTCTTCATCAA

GCTGGACGGCGGGAAAGTGCACGGCGGCAACACCAACAAGTACAGCACCTTCTCCGGCTTCATCATCTACCCCGACTGAG

CCGGC

In a search of public sequence databases, the NOV11a nucleic acid, located on chromsome 17q21, has 565 of 787 bases (71%) identical to a C1q-related factor mRNA from *Homo sapiens*, (GENBANK-ID: AF095154) (E=1.9e$^{-68}$. Public nucleotide databases include all GenBank databases and the GeneSeq patent database.

The disclosed NOV11b polypeptide (SEQ ID NO:30) encoded by SEQ ID NO:29 has 238 amino acid residues and is presented in Table 11D using the one-letter amino acid code. The SignalP, Psort and/or Hydropathy profile for NOV11b predict that this sequence has a signal peptide and is likely to be localized extracellularly with a certainty of 0.5374, as expected by a protein similar to the C1q complement component. In other embodiments, NOV11b is also likely to be localized to the microbody (peroxisome) with a certainty of 0.1199, to the endoplasmic reticulum (membrane) with a certainty of 0.1000, and to the endoplasmic reticulum (lumen) with a certainty of 0.1000. The most likely cleavage site for NOV11b is between positions 15 and 16: VHS-SR.

(E=7.1 e$^{-91}$). Public amino acid databases include the GenBank databases, SwissProt, PDB and PIR.

NOV11b is expressed in at least some of the following tissues: adrenal gland, bone marrow, brain—amygdala, brain—cerebellum, brain—hippocampus, brain—substantia nigra, brain—thalamus, brain—whole, fetal brain, fetal kidney, fetal liver, fetal lung, heart, kidney, lymphoma—Raji, mammary gland, pancreas, pituitary gland, placenta, prostate, salivary gland, skeletal muscle, small intestine, spinal cord, spleen, stomach, testis, thyroid, trachea, uterus, right cerebellum. This information was derived by determining the tissue sources of the sequences that were included in the invention including but not limited to Seq-Calling sources, Public EST sources, Literature sources, and/or RACE sources.

NOV11c

A disclosed NOV11c nucleic acid of 887 nucleotides (also referred to as CG54503-03) encoding a novel C1q-related factor-like protein is shown in Table 11E. An open reading

TABLE 11D

Encoded NOV11b protein sequence.

(SEQ ID NO:30)
MVLLLLVAIPLLVHSSRGPAHYEMLGRCRMVCDPHGPRGPGPDGAPASVPPFPPGAKGEVGRRGKAGLRGPP

GPPGPRGPPGEPGRPGPPGPPGPGPGGVAPAAGYVPRIAFYAGLRRPHEGYEVLRFDDVVTNVGNAYEAASG

KFTCPMPGVYFFAYHVLMRGGDGTSMWADLMKNGQVRASAIAQDADQNYDYASNSVILHLDVGDEVFIKLDG

GKVHGGNTNKYSTFSGFIIYPD

A search of sequence databases reveals that the NOV11b amino acid sequence has 184 of 258 amino acid residues (71%) identical to, and 198 of 258 amino acid residues (76%) similar to, the 258 amino acid residue C1q-related factor precursor protein from *Homo sapiens* (075973)

frame was identified beginning with an ATG initiation codon at nucleotides 19–21 and ending with a TAG codon at nucleotides 880–882. Putative untranslated regions are underlined and are found upstream from the initiation codon and downstream from the termination codon.

TABLE 11E

NOV11c nucleotide sequence (SEQ ID NO:217)

GTCGGCGTACTCTTGGCCATGGCGCTCGGGCTGCTCATCGCCGTGCCGCTGCTGCTGCAGGCGGCGCCCCGAGGCGCCGC

GCACTATGAGATGATGGGCACCTGCCGCATGATCTGCGACCCTTACACTGCCGCGCCCGGCGGGGAGCCCCCGGGTGCAA

AGGCGCAGCCACCCGGACCCAGCACCGCCGCCCTGGAAGTCATGCAGGACCTCAGCGCCAACCCTCCTCCTCCTTTCATC

CAGGGACCCAAGGGCGACCCGGGGCGACCGGGCAAGCCAGGGCCGCGGGGGCCCCCTGGAGAGCCGGGCCCGCCTGGACC

CAGGGGCCCTCCGGGAGAGAAGGGCGACTCGGGGAGGCCCGGGCTGCCAGGGCTGCAACTGACGGCGGGCACGGCCAGCG

GCGTCGGGGTGGTGGGCGGCGGGGCCGGGGTAGGTGGCGATTCCGAGGGTGAAGTGACCAGTGCGCTGAGCGCCACCTTC

AGCGGCCCCAAGATCGCCTTCTATGTGGGTCTCAAGAGCCCCCACGAAGGCTATGAGGTGCTGAAGTTCGATGACGTGGT

CACCAACCTCGGCAATCACTATGACCCCACCACGGGCAAGTTCAGCTGCCAGGTACGCGGCATCTACTTCTTCACCTACC

ACATCCTCATGCGCGGCGGCGACGGCACCAGCATGTGGGCGGACCTCTGCAAGAACGGGCAGGTCCGGGCCAGCGCCATT

GCACAGGACGCCGACCAGAACTACGACTACGCCAGTAACAGCGTGGTGCTGCACTTGGATTCAGGGGACGAAGTGTATGT

GAAGCTGGATGGCGGGAAGGCTCACGGAGGCAATAATAACAAGTACAGCACGTTCTCGGGCTTTCTTCTGTACCCGGATT

AGGGGCG

In a search of public sequence databases, the NOV11c nucleic acid has 538 of 777 bases (69%) identical to a gb:GENBANK-ID:AF095154|acc:AF095154.1 mRNA from *Homo sapiens* (*Homo sapiens* C1q-related factor mRNA, complete cds) (E=8.0e$^{-58}$). Public nucleotide databases include all GenBank databases and the GeneSeq patent database.

The disclosed NOV11c polypeptide (SEQ ID NO:218) encoded by SEQ ID NO:217 has 287 amino acid residues and is presented in Table 11D using the one-letter amino acid code. The SignalP, Psort and/or Hydropathy profile for NOV11c predict that this sequence has a signal peptide and is likely to be localized extracellularly with a certainty of 0.3798, as expected by a protein similar to the C1q complement component. In other embodiments, NOV11c is also likely to be localized to the endoplasmic reticulum (membrane) with a certainty of 0.1000, to the endoplasmic reticulum (lumen) with a certainty of 0.1000, and to the lysosome (lumen) with a certainty of 0.1000. The most likely cleavage site for NOV11c is between positions 21 and 22: GAA-HY.

TABLE 11D

Encoded NOV11c protein sequence (SEQ ID NO:218)

MALGLLIAVPLLLQAAPRGAAHYEMMGTCRMICDPYTAAPGGEPPGAKAQPPGPSTAALEVMQDLSANPPPP

FIQGPKGDPGRPGKPGPRGPPGEPGPPGPRGPPGEKGDSGRPGLPGLQLTAGTASGVGVVGGGAGVGGDSEG

EVTSALSATFSGPKIAFYVGLKSPHEGYEVLKFDDVVTNLGNHYDPTTGKFSCQVRGIYFFTYHILMRGGDG

TSMWADLCKNGQVRASAIAQDADQNYDYASNSVVLHLDSGDEVYVKLDGGKAHGGNNNKYSTFSGFLLYPD

A search of sequence databases reveals that the NOV11c amino acid sequence has 161 of 217 amino acid residues (74%) identical to, and 177 of 217 amino acid residues (81%) similar to, the 255 amino acid residue ptnr:TREMBLNEW-ACC:BAB 15806 protein from *Mus musculus* (Mouse) (Gliacolin) (E=1.9 e$^{-85}$). Public amino acid databases include the GenBank databases, SwissProt, PDB and PIR.

NOV111c is expressed in at least brain. Expression information was derived from the tissue sources of the sequences that were included in the derivation of the sequence of CuraGen Acc. No. CG54503-03.

The disclosed NOV11a polypeptide has homology to the amino acid sequences shown in the BLASTP data listed in Table 11E.

TABLE 11E

BLAST results for NOV11a

| Gene Index/ Identifier | Protein/Organism | Length (aa) | Identity (%) | Positives (%) | Expect |
|---|---|---|---|---|---|
| Ptnr:SWISSPROT-ACC: O75973 | C1q-related factor precursor - Homo sapiens | 258 | 184/258 (71%) | 198/258 (76%) | 9.1e−91 |
| ptnr:SWISSPROT-ACC:O88992 | C1q-related factor precursor - Mus musculus | 258 | 156/216 (72%) | 166/216 (76%) | 1.8e−78 |
| ptnr:SWISSPROT-ACC:Q9ESN4 | Gliacolin precursor - Mus musculus | 155 | 153/209 (73%) | 165/209 (78%) | 1.3e−77 |
| ptnr:SWISSPROT-ACC:P02746 | Complement C1q subcomponent | 251 | 90/239 (37%) | 124/239 (51%) | 1.3e−29 |
| ptnr:TREMBLNEW-ACC:AAH08983 | COMPLEMENT COMPONENT 1 | 253 | 90/239 (37%) | 124/239 (51%) | 1.3e−29 |

The homology between these and other sequences is shown graphically in the ClustalW analysis shown in Table 11F. In the ClustalW alignment of the NOV11 protein, as well as all other ClustalW analyses herein, the black outlined amino acid residues indicate regions of conserved sequence (i.e., regions that may be required to preserve structural or functional properties), whereas non-highlighted amino acid residues are less conserved and can potentially be altered to a much broader extent without altering protein structure or function.

TABLE 11F

ClustalW Analysis of NOV11

```
1) NOV11a (SEQ ID NO:28)
2) NOV11b (SEQ ID NO:30)
3) NOV11c (SEQ ID NO:218)
4) ptnr: C1q-related factor precursor - Homo sapiens (SEQ ID NO:77)
5) ptnr: C1q-related factor precursor - Mus musculus (SEQ ID NO:78)
6) ptnr: Gliacolin precursor - Mus musculus (SEQ ID NO:79)
7) ptnr: Complement C1q subcomponent (SEQ ID NO:80)

10         20         30         40         50         60
                ....|....|....|....|....|....|....|....|....|....|....|....|
NOV11a          ----MVLLLVAIPLLVHSS-RGPAHYEMLGRCRMVCDPHGPR-G---PGP----DGA-- 45
NOV11b          ----MVLLLVAIPLLVHSS-RGPAHYEMLGRCRMVCDPHGPR-G---PGP----DGA-- 45
NOV11c          ----MALGLLIAVPLLLQAAPRGAAHYEMMGICRMICDPYTAAPGGEPPGAKAQPPGPST 56
O75973          ----MLLVLVLIPVLVSSG-GPEGHYEMLGTCRMVCDPYPAR-G---PGAGARTDGG-- 49
O88992          ----MLLVLVVLIPVLVSSG-GPDGHYEMLGTCRMVCDPYPAR-G---PGAGARSDGG-- 49
Q9ESN4          ----MLLVLVVLIPVLVSSG-GPDGHYEMLGTCRMVCDPYPAR-G---PGAGARSDGG-- 49
P02746          --MKIPWGSIPVLMLLLLLGLIDISQAQLSCTGPPAIPGIPGIPG--TPGPDGQ-PGT-- 53
AAH08983        MMMKIPQGSIPVIMLLLLLGLIDISQAQLSCTGPPAIPGIPGIPG--TPGPDGQ-PGT-- 55

70         80         90        100        110        120
                ....|....|....|....|....|....|....|....|....|....|....|....|
NOV11a          ---PAS-----VPP---FPPGAKGEVGRCGKACLRGPPG---PPGERGPPG---EPGRPG 88
NOV11b          ---PAS-----VPP---FPPGAKGEVGRRGKACLRGPPG---PPGERGPPG---EPGRPG 88
NOV11c          AALEVMQDLSANPPPP-FIQGPKGDPGRPGKPCPRGPPGEPGPPGERGPPGEKGDSGRPG 115
O75973          ---DAISEQSGAPPPSTLVQGPQGKPGRTGKPCPPGPPGDPGPPGEVGPPGEKGEPGKPG 106
O88992          ---DAVSEQSGAPPPSTLVQGPQGKPGRTGKPCPPGPPGDPGPPGEVGPPGEKGEPGKPG 106
Q9ESN4          ---DAVSEQSGAPPPSTLVQGPQGKPGRTGKPCPPGPPGDPGPPGEVGPPGEKGEPGKPG 106
P02746          ---PGIKGEKGLPG----DAGDHGEFGEKGDPGIPGNPGKVGPKGEMGPKG---GPGAPG 103
AAH08983        ---PGIKGEKGLPG----DAGDHGEFGEKGDPGIPGNPGKVGPKGEMGPKG---GPGAPG 105
```

TABLE 11F-continued

ClustalW Analysis of NOV11

```
                     130       140       150       160       170       180
                ....|....|....|....|....|....|....|....|....|....|....|....|
NOV11a      PPGPP--------------GPGPGG-------VAPAAGY--VPRIAFYAG--LRRPHEGY 123
NOV11b      PPGPP--------------GPGPGG-------VAPAAGY--VPRIAFYAG--LRRPHEGY 123
NOV11c      LPGLQLTAGTASGVGVVGGGAGVGGDSEGEVTSALSATFS-GPKIAFYVG--LKSPHEGY 172
O75973      PPGLP--------------GAGGSG-------AISTATYTTVPRVAFYAG--LKNPHEGY 143
O88992      PPGLP--------------GAGGSG-------AISTATYTTVPRVAFYAG--LKNPHEGY 143
Q9ESN4      PPGLP--------------GAGGSG-------AISTATYTTVPRVAFYAG--LKNPHEGY 143
P02746      APGPK--------------GE--SG------------DYKATQKIAFSATRTINVPLRRD 135
AAH08983    APGPK--------------GE--SG------------DYKATQKIAFSATRTINVPLRRD 137

190       200       210       220       230       240
                ....|....|....|....|....|....|....|....|....|....|....|....|
NOV11a      EVLRFDDVVTNVGNAYEAASGKFTCPMPGVYFFAYHVLMRGGDGTSMWADLMKNGQVRAS 183
NOV11b      EVLRFDDVVTNVGNAYEAASGKFTCPMPGVYFFAYHVLMRGGDGTSMWADLMKNGQVRAS 183
NOV11c      EVLKFDDVVTNLGNHYDPTTGKFSCQVRGLYFFTYHILMRGGDGTSMWADLCKNGQVRAS 232
O75973      EVLKFDDVVTNLGNNYDAASGKFTCNIPGTYFFTYHVLMRGGDGTSMWADLCKNGQVRAS 203
O88992      EVLKFDDVVTNLGNNYDAASGKFTCNIPGTYFFTYHVLMRGGDGTSMWADLCKNGQVRAS 203
Q9ESN4      EVLKFDDVVTNLGNNYDAASGKFTCNIPGTYFFTYHVLMRGGDGTSMWADLCKNGQVRAS 203
P02746      QTIRFDHVITNMNNNYEPRSGKFTCKVPGLYYFTYHASSRGNLCVNLMRGRER--AQKVV 193
AAH08983    QTIRFDHVITNMNNNYEPRSGKFTCKVPGLYYFTYHASSRGNLCVNLMRGRER--AQKVV 195

250       260       270       280       290
                ....|....|....|....|....|....|....|....|....|....|....|...
NOV11a      AIAQDADQNYDYASNSVILHLDVGDEVFIKLDGGKVHGGNTNKYSTFSGFIIYPD--- 238
NOV11b      AIAQDADQNYDYASNSVILHLDVGDEVFIKLDGGKVHGGNTNKYSTFSGFIIYPD--- 238
NOV11c      AIAQDADQNYDYASNSVVLHLDSGDEVYVKLDGGKAHGGNNNKYSTFSGFLLYPD--- 287
O75973      AIAQDADQNYDYASNSVILHLDAGDEVFIKLDGGKAHGGNSNKYSTFSGFIIYSD--- 258
O88992      AIAQDADQNYDYASNSVILHLDAGDEVFIKLDGGKAHGGNSNKYSTFSGFIIYSD--- 258
Q9ESN4      AIAQDADQNYDYASNSVILHLDAGDEVFIKLDGGKAHGGNSNKYSTFSGFIIYSD--- 258
P02746      TFCDYAYNTFQVTTGGMVLKLEQGENVLEQATDKNSLLGMEGANSIFSGFLLLPDMEA 251
AAH08983    TFCDYAYNTFQVTTGGMVLKLEQGENVLEQATDKNSLLGMEGANSIFSGFLLLPDMEA 253
```

Tables 11E–11F list the domain descriptions from DOMAIN analysis results against NOV11. This indicates that the NOV11 sequence has properties similar to those of other proteins known to contain this domain.

TABLE 11E

Domain Analysis of NOV11 gnl|Smart|smart00110, C1Q, Complement component C1q domain.; Globular domain found in many collagens and eponymously in complement C1q. When part of full length proteins these domains form a 'bouquet' due to the multimerization of heterotrimers. The C1q fold is similar to that of tumour necrosis factor. (SEQ ID NO:104)
CD-Length = 132 residues, 99.2% aligned
Score = 113 bits (283), Expect = 1e-26

```
Query:  108 PRIAFYAGL--RRPHEGYEVLRFDDVVTNVGNAYEAASGKFTCPMPGVYFFAYHVLMRGG 165
            || ||     ||   + +||| |+ |    |+ ++|||||+||||+|+||+
Sbjct:    2 PRSAFSVIRSTNRPPPPGQPVRFDKVLYNQQGHYDPSTGKFTCPVPGVYYFSYHIESK-- 59

Query:  166 DGTSMWADLMKNGQVRASAIAQDADQNYDYASNSVILHLDVGDEVFIKLDGGKVHG-GNT 224
            | ++  ||||       +       |  ||   +|  | ||+|+++|| |
Sbjct:   60 -GRNVKVSLMKNGIQVMRECDEYQKGLYQVASGGALLQLRQGDQVWLELDDKKNGLYAGE 118

Query:  225 NKYSTFSGFIIYPD 238
            ||||||  |+++||
Sbjct:  119 EVDSTFSGFLLFPD 132
```

TABLE 11F

Domain Analysis of NOV11 gnl|Pfam|pfam00386, C1q, C1q domain. C1q is a subunit of the C1 enzyme complex that activates the serum complement system. (SEQ ID NO:112)
CD-Length = 125 residues, 100.0% aligned
Score = 102 bits (253), Expect = 3e-23

```
Query:  111 AFYAGLR-RPHEGYEVLRFDDVVTNVGNAYEAASGKFTCPMPGVYFFAYHVLMRGGDGTS 169
            ||| |   ||   + + ||+|+ |    |+ |+|||||+|+|+|  +||   + ||+
Sbjct:    1 AFTAIRSTRPPAPGQPVIFDEVLYNQQGHYDPATGKFTCPVPGLYYFNFHVSSK---GTN 57
```

TABLE 11F-continued

Domain Analysis of NOV11

```
Query:  170 MWADLMKNGQVRASAIAQDADQNYDYASNSVILHLDVGDEVFIKLDGGKVHG--GNTNKY  227
              +   ||+||     |   +|    |  ||    +|  |   ||  |+++||   + +|    |     +
Sbjct:   58 VCVSLMRNGVPVMSFCDEYAKGTYQVASGGAVLQLRQGDRVWLELDDKQTNGLLGGEGVH  117

Query:  228 STFSGFII  235
              |  ||||++
Sbjct:  118 SVFSGFLL  125
```

The first component of complement system is a calcium-dependent complex of the 3 subcomponents C1q, C1r, and C1s. Subcomponent C1q binds to immunoglobulin complexes with resulting serial activation of C1r (enzyme), C1s (proenzyme) and the other 8 components of complement. It contains collagen like domains. It has been shown that fibronectin binds to C1q in the same manner that it binds collagen. A major function of the fibronectins is in the adhesion of cells to extracellular materials such as solid substrata and matrices. Because fibronectin stimulates endocytosis and promotes the clearance of particulate material from the circulation, the results suggest that fibronectin functions in the clearance of C1q-coated material such as immune complexes or cellular debris. Many examples of deficiencies of C1q have been reported, most of them associated with systemic lupus erythematosus or glomerulonephritis.

The complement system plays a paradoxical role in the development and expression of autoimmunity in humans. The activation of complement in SLE contributes to tissue injury. In contrast, inherited deficiency of classic pathway components, particularly C1q, is probably associated with the development of SLE. This leads to the hypothesis that a physiologic action of the early part of the classic pathway protects against the development of SLE and implies that C1q may play a key role in this respect. C1q-deficient (C1qa−/−) mice have been shown to have increased mortality and higher titers of autoantibodies, compared with strain-matched controls. Of the C1qa−/− mice, 25% have been shown to have glomerulonephritis with immune deposits and multiple apoptotic cell bodies. Among mice without glomerulonephritis, there were significantly greater numbers of glomerular apoptotic bodies in C1q-deficient mice compared with controls. The phenotype associated with C1q deficiency was modified by background genes. These findings are compatible with the hypothesis that C1q deficiency causes autoimmunity by impairment of the clearance of apoptotic cells.

The C1q-related factor is a recently discovered protein which has homology to C1q. Since this is a relatively new discovery, very little is known about its function. But conclusions could clearly be derived from it expression pattern and it homology to C1q. Based on its expression pattern it has been suggested that this protein may be involved in motor function. The functions of C1q has been described above and include role in binding to immunoglobulin complexes, cell adhesion, autoimmunity and apoptosis, among others.

The disclosed NOV11 nucleic acid of the invention encoding a C1q-related factor-like protein includes the nucleic acid whose sequence is provided in Table 11A, 11C, or a fragment thereof. The invention also includes a mutant or variant nucleic acid any of whose bases may be changed from the corresponding base shown in Table 11A or 11C while still encoding a protein that maintains its C1q-related factor-like activities and physiological functions, or a fragment of such a nucleic acid. The invention further includes nucleic acids whose sequences are complementary to those just described, including nucleic acid fragments that are complementary to any of the nucleic acids just described. The invention additionally includes nucleic acids or nucleic acid fragments, or complements thereto, whose structures include chemical modifications. Such modifications include, by way of nonlimiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject. In the mutant or variant nucleic acids, and their complements, up to about 29 percent of the bases may be so changed.

The disclosed NOV11 protein of the invention includes the C1q-related factor-like protein whose sequence is provided in Table 11B or 11D. The invention also includes a mutant or variant protein any of whose residues may be changed from the corresponding residue shown in Table 11B or 11D while still encoding a protein that maintains its C1q-related factor-like activities and physiological functions, or a functional fragment thereof. In the mutant or variant protein, up to about 29 percent of the residues may be so changed.

The protein similarity information, expression pattern, and map location for the C1q-related factor-like protein and nucleic acid disclosed herein suggest that this C1q-related factor may have important structural and/or physiological functions characteristic of the C1q family. Therefore, the nucleic acids and proteins of the invention are useful in potential diagnostic and therapeutic applications and as a research tool. These include serving as a specific or selective nucleic acid or protein diagnostic and/or prognostic marker, wherein the presence or amount of the nucleic acid or the protein are to be assessed, as well as potential therapeutic applications such as the following: (i) a protein therapeutic, (ii) a small molecule drug target, (iii) an antibody target (therapeutic, diagnostic, drug targeting/cytotoxic antibody), (iv) a nucleic acid useful in gene therapy (gene delivery/gene ablation), and (v) a composition promoting tissue regeneration in vitro and in vivo (vi) biological defense weapon.

The nucleic acids and proteins of the invention are useful in potential diagnostic and therapeutic applications implicated in various diseases and disorders described below and/or other pathologies. Based on the TaqMan data, the compositions of the present invention, will have efficacy for treatment of patients suffering from: cancer of the colon, kidney, ovary, skin and brain. Since it is over expressed in cell lines derived from these tissues it can also be used as a diagnostic marker for cancer in these tissues. The expression of the novel gene of this invention upon activation of HUVEC and the homology of the novel protein of this invention to C1q may indicate that it is secreted by endothelial cells in areas of inflammtion where Th1 cells are inflitrating the inflammation site such as Rheumatoid Arthritis and Inflammatory Bowel Disease. Based on its homology to C1q, the novel protein could be either pro-inflammatory activating the complement cascade and be a useful target for a monoclonal antibody to block this effect. Alternatively, this protein may act as a competitor of C1q and so act to down regulate complement mediated damage of endothelial cells. In this case it could be used as a protein therapeutic. IFN gamma also induces production of this protein by airway epithelilial cell lines NCI-H292 and dermal fibroblasts indicating again that it may play a role in Th1 inflammatory diseases such as rheumatoid arthritis, multiple sclerosis, inflammatory bowel diseases and psoriasis and other diseases, disorders and conditions of the like. Because of its high homology to C1q-related factor, this novel protein may also play a role in disorders of the nervous system involved in motor function.

Based on its homology to C1q, the novel protein of invention may also play a role in the pathogenesis of systemic lupus erythematosus and glomerulonephritis and therefore could be used for detection and treatment of these diseases. Thus this protein may be involved in autoimmunity. Since the novel protein of invention has a Collagen triple helix repeat domain, it is likely that this protein may be involved in collagen related disorders and processes such as but not limited to osteogenesis, rheumatoid arthritis and osteoarthritis.

Finally, presence of somatotropin-like domain in the novel protein of invention suggests that it may have somatotropin (growth hormone) like function and behave as a growth hormone and be useful in control of growh and development/differentiation related functions such as but not limited maturation, lactation and puberty. Because of the involvement of growth hormone in many different physiologic functions, the novel protein may be involved in causing osteoporosis, obesity, aging and reproductive malfunction and hence could be used in treatment and/or diagnosis of these disorders.

The NOV11 nucleic acid, or fragments thereof, may further be useful in diagnostic applications, wherein the presence or amount of the nucleic acid or the protein are to be assessed.

NOV11 nucleic acids and polypeptides are further useful in the generation of antibodies that bind immunospecifically to the novel substances of the invention for use in therapeutic or diagnostic methods. These antibodies may be generated according to methods known in the art, using prediction from hydrophobicity charts, as described in the "Anti-NOVX Antibodies" section below. For example the disclosed NOV11 protein have multiple hydrophilic regions, each of which can be used as an immunogen. In one embodiment, contemplated NOV11 epitope is from about amino acids 20 to 120. In another embodiment, the comtemplated NOV11 epitope is from about amino acids 130 to 150. In further embodiments, the contemplated NOV11 epitope is from about amino acids 170 to 210, or from about amino acids 220 to 240. This novel protein also has value in development of powerful assay system for functional analysis of various human disorders, which will help in understanding of pathology of the disease and development of new drug targets for various disorders.

NOV12

A disclosed NOV12 nucleic acid of 5895 nucleotides (also referred to as SC132340676_A) encoding an plexin-1-like protein is shown in Table 12A. An open reading frame was identified beginning with an ATG initiation codon at nucleotides 77–79 and ending with a TGA codon at nucleotides 5798–5800. The putative untranslated regions are underlined and are upstream from the initiation codon and downstream from the termination codon in Table 12A. The start and stop codons are in bold letters.

TABLE 12A

NOV12 nucleotide sequence (SEQ ID NO:31)
CAGGGCTGAAGCTCCTGGCACCATGATGCTCACCCCAGCAGGACCAGAGCACCGAGGCCCAAGGCCCCAGCCTGCCATGC

CGCTGCCACCGCGGAGCCTGCAGGTGCTCCTGCTGCTGCTGCTGTTGCTGCTGCTGCTGCCGGGCATGTGGGCTGAGGCA

GGCTTGCCCAGGGCAGGCGGGGGTTCACAGCCCCCCTTCCGCACCTTCTCGGCCAGCGACTGGGGCCTCACCCACCTAGT

GGTGCATGAGCAGACAGGCGAGGTGTATGTGGGCGCAGTGAACCGCATCTATAAGCTGTCGGGGAACCTGACACTGCTGC

GGGCCCACGTCACGGGCCCTGTGGAGGACAACGAGAAGTGCTACCCGCCGCCCAGCGTGCAGTCCTGCCCCCACGGCCTG

GGCAGTACTGACAACGTCAACAAGCTGCTGCTGCTGGACTATGCCGCTAACCGCCTGCTGGCCTGTGGCAGCGCCTCCCA

GGGCATCTGCCAGTTCCTGCGTCTGGACGATCTCTTCAAACTGGGTGAGCCACACCACCGTAAGGAGCACTACCTGTCCA

GCGTGCAGGAGGCAGGCAGCATGGCGGGCGTGCTCATTGCCGGGCCACCGGGCCAGGGCCAGGCCAAGCTCTTCGTGGGC

ACACCCATCGATGGCAAGTCCGAGTACTTCCCCACACTGTCCAGCCGTCGGCTCATGGCCAACGAGGAGGATGCCGACAT

GTTCGGCTTCGTGTACCAGGATGAGTTTGTGTCATCACAGCTCAAGATCCCTTCGGACACGCTGTCCAAGTTCCCGGCCT

TTGACATCTACTATGTGTACAGCTTCCGCAGCGAGCAGTTTGTCTACTACCTCACGCTGCAGCTAGACACACAGCTGACC

TCGCCTGATGCCGCCGGCGAGCACTTCTTCACGTCCAAGATCGTGCGGCTCTGTGTGGACGACCCCAAATTCTACTCGTA

CGTTGAGTTCCCCATTGGCTGCGAGCAGGCGGGTGTGGAGTACCGCCTGGTGCAGGATGCCTACCTGAGCCGGCCCGGCC

GTGCCCTGGCCCACCAGCTGGGCCTGGCTGAGGACGAGGACGTGCTGTTCACTGTGTTCGCCCAGGGCCAGAAGAACCGC

GTGAAGCCACCAAAGGAGTCAGCACTGTGCCTGTTCACGCTCAGGGCCATCAAGGAGAAGATTAAGGAGCGCATCCAGTC

TABLE 12A-continued

NOV12 nucleotide sequence

```
CTGCTACCGTGGTGAGGGCAAGCTCTCCCTGCCGTGGCTGCTCAACAAGGAGCTGGGCTGCATCAACTCGCCCCTGCAGA
TCGATGACGACTTCTGCGGGCAGGACTTCAACCAGCCCCTGGGGGGCACAGTCACCATTGAGGGGACGCCCCTGTTCGTG
GACAAGGATGATGGCCTGACCGCCGTGGCTGCCTATGACTATCGGGGCCGCACTGTGGTATTCGCCGGCACGCGAAGTGG
CCGCATCCGCAAGATCCTGGTGGACCTCTCAAACCCCGGTGGCCGGCCTGCCCTGGCCTACGAGAGCGTCGTGGCCCAGG
AGGGCAGCCCCATCCTGCGAGACCTCGTCCTCAGCCCCAACCACCAGTACCTCTACGCCATGACCGAGAAGCAGGTGACG
CGGGTGCCTGTGGAGAGCTGTGTGCAGTACACGTCCTGTGAGCTGTGTCTGGGGTCACGGGACCCCCACTGTGGCTGGTG
TGTCCTGCACAGCATGTGCTCGCGGCGGGACGCCTGTGAGCGAGCAGACGAGCCCCAGCGCTTTGCTGCGGACCTGCTGC
AGTGTGTGCAGCTGACTGTGCAGCCCCGCAATGTGTCTGTCACCATGTCCCAGGTCCCAGTACTTGTGCTGCAGGCCTGG
AACGTGCCTGACCTCTCAGCTGGCGTCAACTGCTCCTTCGAGGACTTCACGGAATCTGAGAGCGTCCTGGAGGATGGCCG
GATCCACTGCCGCTCACCCTCCGCCCGGGAGGTGGCGCCCATCACGCGGGGCCAGGGTGAGGGAGACCAGCGGGTGGTGA
AACTCTACCTAAAGTCCAAGGAGACAGGGAAGAAGTTTGCGTCTGTGGACTTCGTCTTCTACAACTGCAGCGTCCACCAG
TCGAGCTGCCTGTCCTGTGTCAACGGCTCCTTTCCCTGCCACTGGTGCAAATACCGCCACGTGTGCACACACAACGTGGC
TGACTGCGCCTTCCTGGAGGGCCGTGTCAACGTGTCTGAGGACTGCCCACAGATCCTGCCCTCCACGCAGATCTACGTGC
CAGTGGGAGTGGTAAAACCCATCACCCTGGCCGCACGGAACCTGCCACAGCCACAGTCAGGCCAGCGTGGATATGAGTGC
CTCTTCCACATCCCGGGCAGCCCGGCCCGTGTCACCGCCCTGCGCTTCAACAGCTCCAGCCTGCAGTGCCAGAATTCCTC
GTACTCCTACGAGGGGAACGATGTCAGCGACCTGCCAGTGAACCTGTCAGTCGTGTGGAACGGCAACTTTGTCATTGACA
ACCCACAGAACATCCAGGCGCACCTCTACAAGTGCCCGGCCCTGCGCGAGAGCTGCGGCCTCTGCCTCAAGGCCGACCCG
CGCTTCGAGTGCGGATGGTGCGTGGCCGAGCGCCGCTGCTCCCTGCGACACCACTGCGCTGCCGACACACCTGCATCGTG
GATGCACGCGCGTCACGGCAGCAGTCGCTGCACCGACCCCAAGATCCTCAAGCTGTCCCCCGAGACGGGCCCGAGGCAGG
GCGGCACGCGGCTCACTATCACAGGCGAGAACCTGGGCCTGCGATTCGAAGACGTGCGTCTGGGCGTGCGCGTGGGCAAG
GTGCTGTGCAGCCCTGTGGAGAGCGAGTACATCAGTGCGGAGCAGATCGTCTGTGAGATCGGGGACGCCAGCTCCGTGCG
TGCCCATGACGCCCTGGTGGAGGTGTGTGTGCGGGACTGCTCACCACACTACCGCGCCCTGTCACCCAAGCGCTTCACCT
TCGTGACACCAACCTTCTACCGTGTGAGCCCCTCCCGTGGGCCTCTGTCAGGGGCACCTGGATTGGCATCGAGGGAAGC
CACCTGAACGCAGGCAGTGATGTGGCTGTGTCGGTCGGTGGCCGGCCCTGCTCCTTCTCCTGGTCCAGGAGGAACTCCCG
TGAGATCCGGTGCCTGACACCCCCGGGCAGAGCCCTGGCAGCGCTCCCATCATCATCAACATCAACCGCGCCCAGCTCA
CCAACCCTGAGGTGAAGTACAACTACACCGAGGACCCCACCATCCTGAGGATCGACCCCGAGTGGAGCATCAACAGCGGT
GGGACCCTCCTGACGGTCACAGGCACCAACCTGGCCACTGTCCGTGAACCCCGAATCCGGGCCAAGTATGGAGGCATTGA
GAGGGAGAACTGCCTGGTGTACAATGACACCACCATGGTATGCCGCGCCCCGTCTGTGGCCAACCCTGTGCGCAGCCCAC
CAGAGCTGGGGAGCGGCCGGATGAGCTGGGCTTCGTCATGGACAACGTGCGCTCCCTGCTTGTGCTCAACTCCACCTCC
TTCCTCTACTACCCTGACCCCGTACTGGAGCCACTCAGCCCCACTGGCCTGCTGGAGCTGAAGCCCAGCTCCCCACTCAT
CCTCAAGGGCCGGAACCTCTTGCCACCTGCACCCGGCAACTCCCGACTCAACTACACGGTGCTCATCGGCTCCACACCCT
GTACCCTCACCGTGTCGGAGACGCAACTGCTGTGCGAGGCGCCCAACCTCACTGGGCAGCACAAGGTCACGGTGCGTGCA
GGTGGCTTCGAGTTCTCGCCAGGGACACTGCAGGTGTACTCGGACAGCCTGCTGACGCTGCCTGCCATTGTGGGCATTGG
CGGAGGCGGGGGTCTCCTGCTGCTGGTCATCGTGGCTGTGCTCATCGCCTACAAGCGCAAGTCACGAGATGCTGACCGCA
CACTCAAGCGGCTGCAGCTCCAGATGGACAACCTGGAGTCCCGCGTGGCCCTCGAATGCAAGGAAGCCTTTGCAGAGCTG
CAGACAGACATCCACGAGCTGACCAATGACCTGGACGGTGCCGGCATCCCCTTCCTTGACTACCGGACATATGCCATGCG
GGTGCTCTTTCCTGGGATCGAGGACCACCCTGTGCTCAAGGAGATGGAGGTACAGGCCAATGTGGAGAAGTCGCTGACAC
TGTTCGGGCAGCTGCTGACCAAGAAGCACTTCCTGCTGACCTTCATCCGCACGCTGGAGGCACAGCGCAGCTTCTCCATG
```

TABLE 12A-continued

NOV12 nucleotide sequence

CGCGACCGCGGGAATGTGGCCTCGCTCATCATGACGGCCCTGCAGGGCGAGATGGAATACGCCACAGGCGTGCTCAAGCA

GCTGCTTTCCGACCTCATCGAGAAGAACCTGGAGAGCAAGAACCACCCCAAGCTGCTACTGCGCCGGCCAACTGAGTCGG

TGGCAGAGAAGATGCTAACTAACTGGTTCACCTTCCTCTTGTATAAGTTCCTCAAGGAGTGCGCTGGGGAGCCGCTGTTC

ATGCTGTACTGCGCCATCAAGCAGCAGATGGAGAAGGGCCCCATTGACGCCATCACGGGTGAGGCACGCTACTCCCTGAG

TGAGGACAAGCTCATCCGGCAGCAGATTGACTACAAGACACTGACCCTGAACTGTGTGAACCCTGAGAATGAGAATGCAC

CTGAGGTGCCGGTGAAGGGGCTGGACTGTGACACGGTCACCCAGGCCAAGGAGAAGCTGCTGGACGCTGCCTACAAGGGC

GTGCCCTACTCCCAGCGGCCCAAGGCCGCGGACATGGACCTGGAGTGGCGCCAGGGCCGCATGGCGCGCATCATCCTGCA

GGACGAGGACGTCACCACCAAGATTGACAACGATTGGAAGAGGCTGAACACACTGGCTCACTACCAGGTGACAGACGGGT

CCTCGGTGGCACTGGTGCCCAAGCAGACGTCCGCCTACAACATCTCCAACTCCTCCACCTTCACCAAGTCCCTCAGCAGA

TACGAGAGCATGCTGCGCACGGCCAGCAGCCCCGACAGCCTGCGCTCGCGCACGCCCATGATCACGCCCGACCTGGAGAG

CGGCACCAAGCTGTGGCACCTGGTGAAGAACCACGACCACCTGGACCAGCGTGAGGGTGACCGCGGCAGCAAGATGGTCT

CGGAGATCTACTTGACACGGCTACTGGCCACCAAGCAGGGCACACTGCAGAAGTTTGTGGACGACCTGTTTGAGACCATC

TTCAGCACGGCACACCGGGGCTCAGCCCTGCCGCTGGCCATCAAGTACATGTTCGACTTCCTGGATGAGCAGGCCGACAA

GCACCAGATCCACGATGCTGACGTGCGCCACACCTGGAAGAGCAACTGCAGCCTGCCCCTGCGCTTCTGGGTGAACGTGA

TCAAGAACCCACAGTTTGTGTTCGACATTCACAAGAACAGCATCACGGACGCCTGCTTGTCGGTGGTGGCCCAGACCTTC

ATGGACTCCTGCTCCACCTCTGAGCACAAGCTGGGCAAGGACTCACCCTCCAACAAGCTGCTCTACGCCAAGGACATCCC

CAACTACAAGAGCTGGGTGGAGAGGAGGTACTATGCAGACATCGCCAAGATGCCAGCCATCAGCGACCAGGACATGAGTG

CGTATCTGGCTGAGCAGTCCCGCCTGCACCTGAGCCAGTTCAACAGCATGAGCGCCTTGCACGAGATCTACTCCTACATC

ACCAAGTACAAGGATGAGGTGCAGATCCTGGCAGCCCTGGAGAAGGATGAGCAGGCGCGGCGGCAGCGGCTGCGGAGCAA

GCTGGAGCAGGTGGTGGACACGATGGCCCTGAGCAGCTGAGCCCCAGCTGTGATCATCCAGCATGATGCAGCGTGAGGAC

AGCTGAGCAGGGACCGGGACAGCCCTCACCGCATGCGTGTGGAGTGTCCGGTGGT.

In a search of public sequence databases, the NOV12 nucleic acid sequence, located on chromsome 8 has 2950 of 3362 bases (87%) identical to a plexin-1 mRNA from *Mus musculus*, (GENBANK-ID: D86948) (E=0.0). Public nucleotide databases include all GenBank databases and the GeneSeq patent database.

The disclosed NOV12 polypeptide (SEQ ID NO:32) encoded by SEQ ID NO:31 has 1925 amino acid residues and is presented in Table 12B using the one-letter amino acid code. Signal P, Psort and/or Hydropathy results predict that NOV12 contains a signal peptide and is likely to be localized in the plasma membrane with a certainty of 0.6000. In other embodiments, NOV12 is likely to be localized to the Golgi body with a certainty of 0.4000, to the endoplasmic reticulum (membrane) with a certainty of 0.1000, or to the endoplasmic reticulum (lumen) with a certainty of 0.1000. The most likely cleavage site for NOV12 is between positions 44 and 45: MWA-EA.

TABLE 12B

Encoded NOV12 protein sequence (SEQ ID NO:32)
MMLTPAGPEHRGPRPQPAMPLPPRSLQVLLLLLLLLLLPGMWAEAGLPRAGGGSQPPFRTFSASDWGLTHL

VVHEQTGEVYVGAVNRIYKLSGNLTLLRAHVTGPVEDNEKCYPPPSVQSCPHGLGSTDNVNKLLLLDYAANR

LLACGCASQGICQFLRLDDLFKLGEPHHRKEHYLSSVQEAGSMAGVLIAGPPGQGQAKLFVGTPIDGKSEYF

PTLSSRRLMANEEDADMFGFVYQDEFVSSQLKIPSDTLSKFPAFDIYYVYSFRSEQFVYYLTLQLDTQLTSP

DAAGEHFFTSKIVRLCVDDPKFYSYVEFPIGCEQAGVEYRLVQDAYLSRPGRALAHQLGLAEDEDVLFTVFA

QGQKNRVKPPKESALCLFTLRAIKEKIKERIQSCYRGEGKLSLPWLLNKELGCINSPLQIDDDFCGQDFNQP

LGGTVTIEGTPLFVDKDDGLTAVAAYDYRGRTVVFAGTRSGRIRKILVDLSNPGGRPALAYESVVAQEGSPI

TABLE 12B-continued

Encoded NOV12 protein sequence

LRDLVLSPNHQYLYAMTEKQVTRVPVESCVQYTSCELCLGSRDPHCGWCVLHSMCSRRDACERADEPQRFAA

DLLQCVQLTVQPRNVSVTMSQVPVLVLQAWNVPDLSAGVNCSFEDFTESESVLEDGRIHCRSPSAREVAPIT

RGQGEGDQRVVKLYLKSKETGKKFASVDFVFYNCSVHQSSCLSCVNGSFPCHWCKYRHVCTHNVADCAFLEG

RVNVSEDCPQILPSTQIYVPVGVVKPITLAARNLPQPQSGQRGYECLFHIPGSPARVTALRFNSSSLQCQNS

SYSYEGNDVSDLPVNLSVVWNGNFVIDNPQNIQAHLYKCPALRESCGLCLKADPRFECGWCVAERRCSLRHH

CAADTPASWMHARHGSSRCTDPKILKLSPETGPRQGGTRLTITGENLGLRFEDVRLGVRVGKVLCSPVESEY

ISAEQIVCEIGDASSVRAHDALVEVCVRDCSPHYRALSPKRFTFVTPTFYRVSPSRGPLSGGTWIGIEGSHL

NAGSDVAVSVGGRPCSFSWSRRNSREIRCLTPPGQSPGSAPIININRAQLTNPEVKYNYTEDPTILRIDPE

WSINSGGTLLTVTGTNLATVREPRIRAKYGGIERENCLVYNDTTMVCRAPSVANPVRSPPELGERPDELGFV

MDNVRSLLVLNSTSFLYYPDPVLEPLSPTGLLELKPSSPLILKGRNLLPPAPGNSRLNYTVLIGSTPCTLTV

SETQLLCEAPNLTGQHKVTVRAGGFEFSPGTLQVYSDSLLTLPAIVGIGGGGGLLLLVIVAVLIAYKRKSRD

ADRTLKRLQLQMDNLESRVALECKEAFAELQTDIHELTNDLDGAGIPFLDYRTYAMRVLFPGIEDHPVLKEM

EVQANVEKSLTLFGQLLTKKHFLLTFIRTLEAQRSFSMRDRGNVASLIMTALQGEMEYATGVLKQLLSDLIE

KNLESKNHPKLLLRRPTESVAEKMLTNWFTFLLYKFLKECAGEPLFMLYCAIKQQMEKGPIDAITGEARYSL

SEDKLIRQQIDYKTLTLNCVNPENENAPEVPVKGLDCDTVTQAKEKLLDAAYKGVPYSQRPKAADMDLEWRQ

GRMARIILQDEDVTTKIDNDWKRLNTLAHYQVTDGSSVALVPKQTSAYNISNSSTFTKSLSRYESMLRTASS

PDSLRSRTPMITPDLESGTKLWHLVKNHDHLDQREGDRGSKMVSEIYLTRLLATKQGTLQKFVDDLFETIFS

TAHRGSALPLAIKYMFDFLDEQADKHQIHDADVRHTWKSNCSLPLRFWVNVIKNPQFVFDIHKNSITDACLS

VVAQTFMDSCSTSEHKLGKDSPSNKLLYAKDIPNYKSWVERRYYADIAKMPAISDQDMSAYLAEQSRLHLSQ

FNSMSALHEIYSYITKYKDEVQILAALEKDEQARRQRLRSKLEQVVDTMALSS

A search of sequence databases reveals that the NOV12 amino acid sequence has 1820 of 1907 amino acid residues (95%) identical to, and 1859 of 1907 amino acid residues (97%) similar to, the 1894 amino acid residue plexin-1 protein from *Mus musculus* (P70206) (E=0.0). Public amino acid databases include the GenBank databases, SwissProt, PDB and PIR.

NOV12 is expressed in at least the following tissues: whole organism, brain, testis, trabecular Bone, lymph, germinal center B cells. In addition, NOV12 is predicted to be expressed in the following tissues because of the expression pattern of (GENBANK-ID: acc:AI255192) a closely related plexin-1 homolog in species *Mus musculus*: brain, testis.

The disclosed NOV12 polypeptide has homology to the amino acid sequences shown in the BLASTP data listed in Table 12C.

TABLE 12C

BLAST results for NOV12

| Gene Index/Identifier | Protein/Organism | Length (aa) | Identity (%) | Positives (%) | Expect |
|---|---|---|---|---|---|
| Ptnr:SPTREMBL-ACC:P70206 | PLEXIN 1 - *Mus musculus* | 1894 | 1820/1907 (95%) | 1859/1907 (97%) | 0.0 |
| ptnr:SPTREMBL-ACC:Q9UIW2 | NOV/PLEXIN-A1 PROTEIN - *Homo sapiens* | 1754 | 1743/1762 (98%) | 1746/1762 (99%) | 0.0 |
| ptnr:SPTREMBL-ACC:Q91823 | PLEXIN PRECURSOR - *Xenopus laevis* | 1905 | 1603/1893 (84%) | 1730/1893 (91%) | 0.0 |
| ptnr:SWISSPROT-ACC:P51805 | Plexin A3 precursor (Plexin 4) | 1871 | 1252/1874 (66%) | 1483/1874 (79%) | 0.0 |
| ptnr:SPTREMBL-ACC:P70208 | PLEXIN 3 - *Mus musculus* | 1872 | 1245/1874 (66%) | 1478/1874 (76%) | 0.0 |

The homology between these and other sequences is shown graphically in the ClustalW analysis shown in Table 12D. In the ClustalW alignment of the NOV12 protein, as well as all other ClustalW analyses herein, the black outlined amino acid residues indicate regions of conserved sequence (i.e., regions that may be required to preserve structural or functional properties), whereas non-highlighted amino acid residues are less conserved and can potentially be altered to a much broader extent without altering protein structure or function.

TABLE 12D

ClustalW Analysis of NOV12

1) NOV12 (SEQ ID NO:32)
2) ptnr: PLEXIN 1 - Mus musculus (SEQ ID NO:81)
3) ptnr: NOV/PLEXIN-A1 PROTEIN - Homo sapiens (SEQ ID NO:82)
4) ptnr: PLEXIN PRECURSOR - Xenopus laevis (SEQ ID NO:83)
5) ptnr: Plexin A3 precursor (Plexin 4) (SEQ ID NO:84)
6)

```
NOV12   MMLTPAGPEHRGPRPQPAMPLPPRSLQVLLLLLLLLLLLPGMWAEAGLPRAGGGSQPFFRTFSASDWGLTHLVVHEQTGE  80
P70206  --------------------MPLPPLSSRTLLLLLLLLLRGVWIAISSPPAGLGEQPAFRTFVASDWGLTHLVVHEQTGE  60
Q9UIW2  ----------------------------GMWAEAGLPRAGGGSQPFFRTFSGSDWGLTHLLVHEQTGE  40
Q91823  --------------------MLLHAERPLPFHLWTFLVFLGSWIFAT-----GDGSPKDFRTFTGSDWSLTHLVVHNKTGE  55
P51805  ----------------------------MPSVCLLLLLFLAVG----GALGNRPPRAFVVTDTTLTHLAVHRVTGE  44

NOV12   VYVGAVNRIYKLSGNLTLLRAHVTGPVEDNEKVYPPPSVQCSPHGLGSTDNVNKLLLLDYAANRLLACGSASQGICQFLF  160
P70206  VYVGAVNRIYKLSGNLTLLRAHVTGPVEDNEKVYPPPSVQCSPHGLGSTDNVNKLLLLDYAANRLLACGSASQGICQFLF  140
Q9UIW2  VYVGAVNRIYKLSGNLTLLRAHVTGPVEDNEKVYPPXVQCSPHGLGNTDNVNKLLLLDYAANRLLACGSASQGICQSLF  120
Q91823  VYVGAINRIYKLSNNLTLLRTHVTGPVEDNEKVYPPPSVQCSPHGLITTNNVNKLLLIDYSDNRLKACGSASQGICQFLF  135
P51805  VFVGAVNRVFKLAPNLTELRAHVTGPVEDNAPVYPPPSMRVSAHRLAPVDNINKLLLIDYAANRLVACGSIWQGICQFLF  124

NOV12   LDDLFKLGEPHHRKEHYLSSVQEAGSMAGVLIAGPPGQGQAKLFVGTPIDGKSEYFPTLSSRRLMANEEDADMFGFVYQL  240
P70206  LDDLFKLGEPHHRKEHYLSSVREAGSMAGVLIAGPPGQGQAKLFVGTPIDGKSEYFPTLSSRRLMANEEDADMFGFVYQL  220
Q9UIW2  LDXLFKLGEPHHRKEHYLSSVQEAGSMAGVLIAGPPGQGQAKLFVGTPIDGKSEYFPTLSSRRLMANEEDADMFGFVYQL  200
Q91823  LDDLFKLGEPHHRKEHYLSSVNESG--------------------------------------------------------  160
P51805  LDDLFKLGEPHHRKEHYLSGADEPDSMAGVIVE--QGQGPSKLFVGTAVDGKSEYFPTLSERKLISDEDSADMFSLVYQL  202

NOV12   EFVSSQLKIPSDTLSKFPAFDIYYVYSFRSEQFVYYLTLQLDTQLTSPDAAGEHFFTSKIVRLCVDDPKFYSYVEFPIGC  320
P70206  EFVSSQLKIPSDTLSKFPAFDIYYVYSFRSEQFVYYLTLQLDTQLTSPDAAGEHFFTSKIVRLCVNDPKFYSYVEFPIGC  300
Q9UIW2  EFVSSQLKIPSDTLSKFPAFDIYYVYSFRSEQFVYYLTLQLDTQLTSPDAAGEHFFTSKIVRLCVDDPKFYSYVEFPIGC  280
Q91823  --------------------------------------------------------------------------------  160
P51805  EFVSSQLKIPSDTLSLYPALDIYYLYGFVSASFVYRLTLQLDTQQLLLDIAGEKFFTSKIVRMGAGDSSFYSYVEFPIGC  282

NOV12   EQAGVEYRLVQDAYLSRPGRALAHQLGLAEDEDVLFTVFAQGQFNRVKPPKESALCLFTLRAIKEKIKERIQSCYRGEGK  400
P70206  EQAGVEYRLVQDAYLSRPGQALAKQLGLAEDEEVLFTVFAQGQFNRVKPPKESALCLFTLRAIKEKIKERIQSCYRGEGK  380
Q9UIW2  EQAGVEYRLVQDAYLSRPGRALAHQLGLAEDEDVLFTVFAQGQFNRVKPPKESALCLFTLRAIKEKIKERIQSCYRGEGK  360
Q91823  --------------------------------------------------------------------------------  160
P51805  SWRGVEYRLVQSAHLAKPGLLLAQALGVPADEDVLFTIFSQGQKNRASPPRQTILCLFTLSNINAHIRRRIQSCYRGEGT  362

NOV12   LSLPWLLNKELGCINSPLQIDDDFCGQDFNQPLGGTVTIEGTPLFVDKDDGLTAVAAYDYRGRTVVFAGTRSGRIRKILV  480
P70206  LSLPWLLNKELGCINSPLQIDDDFCGQDFNQPLGGTVTIEGTPLFVDKEDGLTAVAAYDYQGRTVVFAGTRSGRIRKILV  460
Q9UIW2  LSLPWLLNKELGCINSPLQIDDDFRGQDFNQPLGGTVTIEGTPLFVDKDDGLTAVAAYDYRGRTVVFAGTRSGRIRKILV  440
Q91823  --------------------------------------------------------------------------------  160
P51805  LALPWLLNKELPCINTPXQINGNFCGLVLNQPLGGLHVIEGLPLLADSTDGMASVAAYTYRQHSVVFIGTRSGSLKKVRV  442

NOV12   DLSNPGGRPALAYESVVAQEGSPILRDLVLSPNHQYLYANTEKQVTRVPVESCVQYTSCELCLGSRDPHVGWCVLHSMCS  560
P70206  DLANPSGRPALAYESVVAQEGNPILRDLVLSPNRQYLYANTEKQVTQVPVESCVQYTSCELCLGSRDPHVGWCVLHSICS  540
Q9UIW2  DLSNPGGRPALAYESVVAQEGSPILRDLVLSPNHQYLYANTEKQVTRVPVESCVQYTSCELCLGSRDPHVGWCVLHSICS  520
Q91823  --------------------------------------------------------------------------------  160
P51805  DG----FQDAHLYEIVPVVDGSPILRDLLFSPDHRHIYLLSEKQVSQLPVETCEQYQSCAACLGSGDPHCGWCVLRHRCC  512

NOV12   RRDACERADEPQRFAADLLQCVQLTVQPRNVSVTMSQVPVLVLQAWNVPDLSAGVNCSFEDFTESESVLE-DGRIHCRSP  639
P70206  RQDACERAEPQRFASDLLQCVQLTVQPRNVSVTMSQVP-LVLQAWNVPDLSAGVNCSFEDFTEPESILE-DGRIHCHSP  618
Q9UIW2  RRDACERADEPQRFAADLLQCVQLTVQPRNVSVTMSQVP-LVLQAWNVPDLSAGVNCSFEDFTESESVLE-DGRIHCRSP  598
Q91823  --------------------------------------------------------------------------------  160
P51805  REGACLGASAPHGFAEELSKCVQVRVRPNNVSVTSPGVQ-LTVTLHNVPDLSAGVSCAFEAAAENEAVLLPSGELLCPSP  597

NOV12   SAREVAPITRGQGEGDQRVVKLYLKSKETGKKFASVDFVFYNCSVHQSSCLSCVNGSFPCHWCKYRHVCYHNVADCAFLE  719
P70206  SAREVAPITQGQ--GDQRVVKLYLKSKETGKKFASVDFVFYNCSVHQS-CLACVNGSFPCHWCKYRHVCYNNAADCAFLE  695
Q9UIW2  SAREVAPITRGQ--GDQRVVKLYXKSKETGKKFASVDFVFYNCSVHQS-CLSCVNGSFPCHWCKYRHVCYHNVADCAFLE  675
Q91823  --------------------------------------------------------------------------------  160
P51805  SLQERALTRCH--GATETVRLQLLSKETCVRFAGADFVFYNCSVLQE-CMSCVGSPYPCHWCKYRHTCISRPHECSFQE  674

NOV12   GRVNVSEDCPQILPSTQIYVPVGVVKPITLAARNLPQPQSCQRGYECLFHIPGSPARVTALRFNSSSLQCQNSSYSYEGN  799
P70206  GRVNMSEDCPQILPSTHIYVPVGVVKPITLAARNLPQPQSCQRGYECLFHIPGSPARVTALRFNSSSLQCQNSSYSYEGN  775
Q9UIW2  GRVNVSEDCPQILPSTQIYVPVGVVKPITLAARNLPQPQSCQRGYECLFHIPGSPARVTALRFNSSSLQCQNSSYSYEGN  755
Q91823  --------------------------------------------------------------------------------  160
P51805  GRVHSPEGCPEILPSGDLLIPVGVMQPLTLRAKNLPQPQSGQKNYECVVRVQGRQQRVPAVRFNSSSVQCQNASYSYEGD  754
```

TABLE 12D-continued

ClustalW Analysis of NOV12

```
NOV12   DVSDLPVNLSVVWNCNFVIDNPCNIQAHLYKCPALRESCGLCLKADPRFECGWCVAERRCSLRHHCAADRPASWMHARHC  879
P70206  DVSDLPVNLSVVWNCNFVIDNPCNIQAHLYKCPALRQSCGLCLKADPRFECGWCVAERRCSLRHHCPADSPASWMHAHHC  855
Q9UIW2  DVSDLPVNLSVVWNCNFVIDNPCNIQAHLYKCPALRESCGLCLKADPRFECGWCVAERRCSLRHHCAADRPASWMHARHC  835
Q91823  --------------------------------------------------------------------------------  160
P51805  EHGDTELDFSVVWDCDFPILKPPSFRALLYKCWAQFPSCGLCLKADPRFNCGWCISDHRCQLRTHCPAPKTN-WMHLSQK  833

NOV12   SSRCTDPKILKLSPETGPRQGGTRLTITCENLGLRFEDVRLGVRVGKVLCSPVESEYISAEQIVCEIGDASSVRAHDALV  959
P70206  SSRCTDPKILKLSPETGPRQGGTRLTITCENLGLRFEDVRLGVHVGKVLCSPVESEYISAEQIVCEIGDASTLRAHDALV  935
Q9UIW2  SSRCTDPKILKLSPETGPRQGGTRLTITCENLGLRFEDVRLGVRVGKVLCSPVESEYISAEQIVCEIGDASSVRAHDALV  915
Q91823  --------------------------------------------------------------------------------  160
P51805  GIRCSHPRITQIHPLVGPKEGGTRVTIVGENLGLLSREVGLRVAG--VRQNSIPAEYISAERIVCEMEESLVPSPPPGPV  911

NOV12   EVCVRDCSPHYRALSPKRFTFVTPTFYRVSPSRGPLSGGTWIGIEGSHLNAGSDVAVSVGGRPCSFSWSRENSREIRCLT  1039
P70206  EVCVRDCSLHYRALSPKRFTFVTPTFYRVSPSRGPLSGGTWIGIEGSHLNAGSDVAVSIGGRPCSFSW--ENSREIRCLT  1013
Q9UIW2  EVCVRDCSPHYRALSPKRFTFVTPTFYRVSPSRGPLSGGTWIGIEGSHLNAGSDVAVSVGGRPCSFSW--ENSREIRCLT  993
Q91823  --------------------------------------------------------------------------------  160
P51805  ELCVGDCSADFRTQSECVXSFVTPTFDQVSPSRGEASGGTRLTISGSSDDAGSRVTVTVRDSECQFVR--RDAKAIVCIS  989

NOV12   PPCQS-PGSAPIIININRAQLTNPEVKYNYTEDPTILRIDPEWSINSGGTLLTVTGTNLATVREPRIRAKYGGIEREN-C  1117
P70206  PPCHI-PGSAPIVININRAQLSNPEVKYNYTEDPTILRIDPEWSINSGGTLLTVTGTNLATVREPRIRAKYGGIERENSC  1092
Q9UIW2  PPCQS-PGSAPIIININRAQLTNPEVKYNYTEDPTILRIDPEWSINSGGTLLTVTGTNLATVREPRIRAKYGGIERENGC  1072
Q91823  --------------------------------------------------------------------------------  160
P51805  PLSTLGPSQAPITLAIDRANISSPGAIYTYTQDPTVTRLEPTWSIINGSIAITVSGTHLLIVQEPRVRAKYRGIETTNTC  1069

NOV12   LVYNDTTMVCRAPSVANFVRSPPELGERPDELGFVMDNVRSLLVLNSISFLYYPDPVLEPLSPTGLLELKPSSPLILKGF  1197
P70206  MVYNDTTMVCRAPSIDNFKRSPPELGERPDEIGFIMDNVRILLVLNSSSFLYYPDPVLEPLSPTGLLELKPSSPLILKGF  1172
Q9UIW2  LVYNDTTMVCRAPSVANFVRSPPELGERPDELGFVMDNVRSLLVLNSTSFLYYPDPVLEPLSPTGLLELKPSSPLILKGF  1152
Q91823  --------------------------------------------------------------------------------  160
P51805  QVINDTAMLCKAPGIFLGRPQPRAQGEHPDEFGELLDHVQTARSLNRSSFTYYPDPSFEPLGPSCVLDVKPGSHVVLKGK  1149

NOV12   NLLPPAPGNSRLNYTVLTCSTPCILTVSETQLLCEAPNLTGQHKVTVRAGGFEFSPGTLQVYSDSLLTLPAIVGIGGGGG  1277
P70206  NLLPPAPGNSRLNYTVLTCSTPCILTVSETQLLCEAPNLTGQHKVTVRAGGFEFSPGMLQVYSDSLLTLPAIVGIGGGGG  1252
Q9UIW2  NLLPPAPGNSRLNYTVLTCSTPCILTVSETQLLCEAPNLTGQHKVTVRAGGFEFSPGTLQVYSDSLLTLPAIVGIGGGGG  1232
Q91823  --------------------------------------------------------------------------------  160
P51805  NLIEAAAGSSRLNYTVLIGGQPCSLTVSDTQLLCDSPSQTGRQPVMVLVGGLEFWLGTLHISAERALTLPAMMGLAAGGG  1229

NOV12   LLLLVIVAVLIAYKRKSRDADRTLKRLQLQMDNLESRVALECKEAFAELQTDIHELTNDLDGAGIPFLDYRTYAMRVLFF  1357
P70206  LLLLVIVAVLIAYKRKSRDADRTLKRLQLQMDNLESRVALECKEAFAELQTDIHELTSDLDGAGIPFLDYRTYAMRVLFF  1332
Q9UIW2  LLLLVIVAVLIAYKRKSRDADRTLKRLQLQMDNLESRVALECKEAFAELQTDIHELTNDLDGAGIPFLDYRTYAMRVLFF  1312
Q91823  --------------------------------------------------------------------------------  160
P51805  LLLLAITAVIVAYKRKTQDADRTLKRLQLQMDNLESRVALECKEAFAELQTDINELTNHMDEVQIPFLDYRTYAVRVLFF  1309

NOV12   GIEDHPVLKEMEVQANVEKSLTLFGQLLTKKHFLLTFIRTLEAQRSFSMRDRGNVASLIMTALQGEMEYATGVLKQLLSD  1437
P70206  GIEDHPVLKEMEVQANVEKSLTLFGQLLTKKHFLLTFIRTLEAQRSFSMRDRGNVASLIMTALQGEMEYATGVLKQLLSD  1412
Q9UIW2  GIEDHPVLKEMEVQANVEKSLTLFGQLLTKKHFLLTFIRTLEAQRSFSMRDRGNVASLIMTALQGEMEYATGVLKQLLSD  1392
Q91823  --------------------------------------------------------------------------------  160
P51805  GIEAHPVLKELDTPPNVEKALRLFGQLLHSRAFVLTFIHTLEAQSSFSMRDRGNVASLTVVALQSRIDYATGLLKQLLAD  1389

NOV12   LIEKNLESKNHPKLLLRRPTESVAEKMLTNWFTFLLYKFLKECAGEPLFMLYCAIKQQMEKGPIDAITGEARYSLSEDKL  1517
P70206  LIEKNLESKNHPKLLLRR-TESVAEKMLTNWFTFLLYKFLKECAGEPLFMLYCAIKQQMEKGPIDAITGEARYSLSEDKL  1491
Q9UIW2  LIEKNLESKNHPKLLLRR-TESVAEKMLTNWFTFLLYKFLKECAGEPLFMLYCAIKQQMEKGPIDAITGEARYSLSEDKL  1471
Q91823  --------------------------------------------------------------------------------  160
P51805  LIEKNLESKNHPKLLLRR-TESVAEKMLTNWFTFLLHKFLKECAGEPLFILYCAIKQQMEKGPIDAITGEARYSLSEDKL  1468

NOV12   IRQQIDYKTLTLNCVNPENENAPEVPVKGLDCDTVTQAKEKLLDAAYKCVPYSQRPKAADMDLEWRQGRMARIILQDEDV  1597
P70206  IRQQIDYKTLTLNCVNPEHENAPEVPVKGLNCDTVTQVKEKLLDAVYKCVPYSQRPKAGDMDLEWRQGRMARIILQDEDV  1571
Q9UIW2  IRXQIDYKTLTLNCVNPENENAPEVPVKGLDCDTVTQAKEKLLDAAYKCVPYSQRPKAADMDLEWRQGRMARIILQDEDV  1551
Q91823  --------------------------------------------------------------------------------  160
P51805  IRQQIDYKTLTLHCVCPEEEGAAQVPVKVLNCDSITQAKDKLLDIVYKCIPYSQRPKAEDMDLEWRQGRMTRIILQDEDV  1548

NOV12   TTKIDNDWKRLNTLAHYQVTDGSSVALVPKQTSAYNISNSSTFTKSLSRYESMLRTASSPDSLRSRTPMITPDLESGTKL  1677
P70206  TTKIDNDWKRLNTLAHYQVTDGSSVALVPKQTSAYNISNSSTFTKSLSRYESMLRTASSPDSLRSRTPMITPDLESGTKL  1651
Q9UIW2  TTKIDNDWKRLNTLAHYQVTDGSSVALVPKQTSAYNISNSSTFTKSLSRYESMLRTASSPDSLRSRTPMITPDLESGTKL  1631
Q91823  --------------------------------------------------------------------------------  160
P51805  TTKIECDWKRLNSLAHYQVTDGSLVALVPKQVSAYNMANSFTFTRSLSRYESLLRTASSPDSLRSRAPMITPDQETGTKL  1628

NOV12   WHLVKNHDHLDQREGDRGSKMVSEIYLTRLLATKQGTLQKFVDDLFETIFSTAHRGDALPLAIKYMFDFLDEQADKHQIH  1757
P70206  WHLVKNHDHLDQREGDRGSKMVSEIYLTRLLATKG-TLQKFVDDLFETIFSTAHRGDALPLAIKYMFDFLDEQADKHQIH  1730
Q9UIW2  WHLVKNHDHLDQREGDRGSKMVSEIYLTRLLATKG-TLQKFVDDLFETIFSTAHRGDALPLAIKYMFDFLDEQADKHQIH  1710
Q91823  --------------------------------------------------------------------------------  160
P51805  WHLVKNHDHADHREGDRGSKMVSEIYLTRLLATKG-TLQKFVDDLFETIVFSTAHRGDALPLAIKYMFDFLDEQADQRQIS  1707

NOV12   DADVRHTWKSNQSLPLRFWVNVIKNPQFVFDIHKNSITDACLSVVAQTFMDSVSTEHRLGKDSPSNKLLYAKDIPNYKS  1837
P70206  DSDVRHTWKSNQ-LPLRFWVNVIKNPQFVFDIHKNSITDACLSVVAQTFMDSVSTEHRLGKDSPSNKLLYAKDIPNYKS  1809
Q9UIW2  DSDVRHTWKSNQ-LPLRFWVNVIKNPQFVFDIHKNSITDACLSVV-----------------------------------  1754
Q91823  --------------------------------------------------------------------------------  160
P51805  DEDVRHTWKSNQ-LPLRFWVNVIKNPQFVFDIHKNSITDACLSVVAQTFMDSVSTEHRLGKDSPSNKLLYAKDIPNYKS  1786
```

TABLE 12D-continued

ClustalW Analysis of NOV12

```
NOV12   WVERRYYADIAKMPAISDQDMSAYIAEQSRLHLSQENSMSALHEIYSYITKYKDEVQIIAALEKDEQARRQRLESKLEQV  1917
P70206  WVER-YYADIAKMPAISDQDMSAYIAEQSRLHLSQENSMSALHEIYSYIAKYKD--EIIAALEKDEQARRQRLESKLEQV  1886
Q9UIW2  ----------------------------------------------------------------------------  1754
Q91823  ----------------------------------------------------------------------------  160
P51805  WVER-YYRDIAKMASISDQDMDAYIVEQSRLHASDESVLSALNELYFYVTKYRQ--EITTALDRLASCRKHKLEQKLEQI  1863

NOV12   VDTMALSS  1925
P70206  VDTMALSS  1894
Q9UIW2  --------  1754
Q91823  --------  160
P51805  ISLVSSDS  1871
```

Tables 12E–12N list the domain descriptions from DOMAIN analysis results against NOV12. This indicates that the NOV12 sequence has properties similar to those of other proteins known to contain this domain.

TABLE 12E

Domain Analysis of NOV12 gnl|Smart|smart00630, Sema, semaphorin domain (SEQ ID NO:113)
CD-Length = 430 residues, 100.0% aligned
Score = 242 bits (618), Expect = 1e-64

```
Query:   69 LTHLVVHEQTGEVYVGAVNRIYKLSGNLTLLRAHVTGPVEDNEKCYPPPSVQSCPHGLGS  128
            | +|++ |    |+||||  ||+| ||  ||      ||||   +   |
Sbjct:    1 LQNLLLDEDNGTLYVGARNRLYVLSLNLISEAEVKTGPVLSSPDCEEC--VSKGKDPP--  56

Query:  129 TDNVNK-LLLLDYAANRLLACGS-ASQGICQFLRLDDLFKLGEPHHRKEHYLSSVQEAGS  186
            || ||   ||||| |+ || ||+ |  | | +|  +  +|  +|              +
Sbjct:   57 TDCVNFIRLLLDYNADHLLVCGTNAFQPVCRLINLGNLDRL-EVGRESGRGRCPFDPQHN  115

Query:  187 MAGVLIAGPPGQGQAKLFVGTPID--GKSEYFPTLSSRRLMANEEDADMFGFVYQDEFVS  244
            ||+ |      +|+||| |     |    | +    |
Sbjct:  116 STAVLVDG-------ELYVGTVADFSGSDPAIYRSLSVRRLKGTSG-------PSLRTVL  161

Query:  245 SQLKIPSDTLSKFPAFDIYYVYSFRSEQFVYYLTLQLDTQLTSPDAAGEHFFTSKIVRLC  304
             + +       + +|+|  |   +  +|+|+|   |     +  +   |   |++ |+|
Sbjct:  162 YDSRWLN---------EPNFVYAFESGDFVYF----FFRETAVEDENCGKAVVSRVARVC  208

Query:  305 VDD--------PKFYSYVEFPIGC---EQAGVEYRLVQDAYLSRPGRALAHQLGLAEDED  353
            +|         |+ |+++ +    |        + +  +| |+|   |        +| +|
Sbjct:  209 KNDVGGPRSLSKKWTSFLKARLECSVPGEFPFYFNELQAAFLLPAG---------SESDD  259

Query:  354 VLFTVFAQGQKNRVKPPKESALCLFTLRAIKEKIKERIQSCYRGEGKLSL----PWLLNK  409
            ||+| ||+          ||+| |+|  |    |  |    +           +
Sbjct:  260 VLYGVFSTS----SNPIPGSAVCAFSLSDINAVFNEPFKECETGNSQWLPYPRGLVPFPR  315

Query:  410 ELGCINSPLQI----DDDFC-GQDFNQPLGGTVTIEGTPLFV--DKDDGLTAVAA----Y  458
            |  |+||    ||    +         + | ||||  | +   ||++|
Sbjct:  316 PGTCPNTPLSSKDLPDDVLNFIKTHPLMDEVVQPLTCRPLFVKTDSNYLLTSIAVDRVRT  375

Query:  459 DYRGRTVVFAGTRSGRIRKILVDLSNPGGRPALAYESVVAQEGSPILRDLVLSPNH  514
            |     ||+| ||   |||  |+++  |+    |    |    ||||+ |||||
Sbjct:  376 DGGNYTVLFLGTSDGRILKVVLSRSSSSSESVVLEEISVFDPGSPV-SDLVLSPKK  430
```

TABLE 12F

Domain Analysis of NOV12 gnl|Pfam|pfam01403, Sema, Sema domain. The Sema domain occurs in semaphorins, which are a large family of secreted and transmembrane proteins, some of which function as repellent signals during axon guidance. Sema domains also occur in the hepatocyte growth factor receptor. (SEQ ID NO:114)
CD-Length = 433 residues, 99.5% aligned
Score = 171 bits (432), Expect = 5e-43

```
Query:   69 LTHLVVHEQTGEVYVGAVNRIYKLSGN----LTLLRAHVTGPVEDNEKCYPPPSVQSCPH  124
            |++ |   | +||||  ||+| |+  +       |+    |    |  |+|
Sbjct:    1 FVTLLLDEDRGRLYVGARNRVYVLNLEDLSEVLNLKTGWPGSCETCEECNMKGKSP----  56
```

TABLE 12F-continued

Domain Analysis of NOV12

```
Query:   125 GLGSTDNVW-KLLLLDYAANRLLACGS-ASQGICQFLRLDDLFKLGEPHHRKEHYLSSVQ 182
             |+  |   +|   |    |  ||+ | | +|  + | |||  |     +
Sbjct:    57 ---LTECTNFIRVLQAYNDTHLYVCGTNAFQPVCTLINLGDLFSLDVDNEEDGCGDCPYD 113

Query:   183 EAGSMAGVLIAGPPGQGQAKLFVGTPIDGKSEYFPTLSSRRLMANEEDADMFGFVYQDEF 242
             |+  ||+ |       +|+ || ||    +      +      |     +
Sbjct:   114 PLGNTTSVLVQG------GELYSGTVID------FSGRDPSIRRLLGSHDGLRTEFHD-- 159

Query:   243 VSSQLKIPSDTLSKFPAFDIYYVYSFRSEQFVYYLTLQLDTQLTSPDAAGEHFFTSKIVR 302
             |  | +|+       ++ |+||+||  |+  ||+     +      |+  +    |++ |
Sbjct:   160 -SKWLNLPNFVD----SYPIHYVHSF-SDDKVYF----FFRETAVEDSNCKTIH-SIWAR 208

Query:   303 LCVDDPKFYSYVEFPIGC-------------EQAGVEYRLVQDAYLSRPGRALAHQLGLA 349
             +| +||   ||+|    |+|             |   + +|  |++     |
Sbjct:   209 VCKNDPGGRSYLELNKWTTFLKARLNCSIPGEGTPFYFNELQAAFVLPTG---------A 259

Query:   350 EDEDVLFTVFAQGQKNRVKPPKESALCLFTLRAIKE--KIKERIQSCYRCEGKLSLPWLL 407
             + +  ||+ ||            ||+| |++ | +   + ||
Sbjct:   260 DTDPVLYGVFTTS----SNSSAGSAVCAFSNSDINQVFEGPFKHQSPNSKWLPYRGKVPQ 315

Query:   408 NKELGCINSP-LQIDDDFCGQDFNQPLGGTVT--IEGTPLFVDKDDG--LTAVA-----A 457
             +   | |+  | +|    ||   |  +   ||||  +   ||++|     |
Sbjct:   316 PRPGQCPNASGLNLPDDTLNFIRCHPLMDEVVPPLHNVPLFVGQSGNYRLTSIAVDRVRA 375

Query:   458 YDYRGRTVVFAGTRSORIRKILVDLSNPGGR---PALAYESVVAQEGSPILRDLVLS 511
             | +  ||+| ||  ||+    |  ||           +  ||+  +|   | + ++ |
Sbjct:   376 GDGQIYTVLFLGTDDGRV-LKQVVLSRSSSASYLVVVLEESLVFPDGEPVQRMVISS 431
```

TABLE 12G

Domain Analysis of NOV12 gnl|Pfam|pfam01833, TIC, IPT/TIG domain. This family consists of a
domain that has an immunoglobulin like fold. These domains are found
in cell surface receptors such as Met and Ron as well as in
intracellular transcription factors where it is involved in DNA
binding. (SEQ ID NO:115)
CD-Length = 85 residues, 100.0% aligned
Score = 78.2 bits (191), Expect = 4e-15

```
Query:   983 PTFYRVSPSRGPLSGGTWIGIEGSHLNAGSDVAVSVGGRPCSFSWSRRNSREIRCLTPPG 1042
             |   +|||  ||||||| |  | ||+| +|  |+  ||    |  + +|   |  |||
Sbjct:     1 PVITSISPSSGPLSGGTEITITGSNLGSGEDIKVTFGGTECDV--VSQEASQIVCKTPPY 58

Query:  1043 QSPGSAPIIININRAQLTNPEVKYNYT 1069
             +  |  |+ ++++  |++   +  |
Sbjct:    59 ANGGPQPVTVSLDGGGLSSSPVTFTYV 85
```

TABLE 12H

Domain Analysis of NOV12 gnl|Pfam|pfam01833, TIG, IPT/TIG domain. This family consists of a
domain that has an immunoglobulin like fold. These domains are found
in cell surface receptors such as Met and Ron as well as in
intracellular transcription factors where it is involved in DNA
binding. (SEQ ID NO:115)
CD-Length = 85 residues, 100.0% aligned
Score = 60.1 bits (144), Expect = 1e-09

```
Query:   886 PKILKLSPETGPRQGGTRLTITGENLGLRFEDVRLGVRVGKVLCSPVESEYISAEQIVCE 945
             |    |  +|| +|| +|||||||||+|  | |+|||   +|+|  +  |   |+|+|+
Sbjct:     1 PVITSISPSSGPLSGGTEITITGSNLGS---GEDIKVTFGGTECDVVSQEA---SQIVCK 54

Query:   946 IGDASSVRAHDALVEVCVRDCSPHYRALSPKRFTFV 981
             ++          |  +    |  |+ ||+|
Sbjct:    55 TPPYANGGPQPVTVSLDGGGLSS------SPVTFTYV 85
```

TABLE 12I

Domain Analysis of NOV12 gnl|Pfam|pfam01833, TIG, IPT/TIG domain. This family consists of a
domain that has an immunoglobulin like fold. These domains are found
in cell surface receptors such as Met and Ron as well as in
intracellular transcription factors where it is involved in DNA
binding. (SEQ ID NO:115)
CD-Length = 85 residues, 100.0% aligned
Score = 46.6 bits (109), Expect = 1e-05

```
Query:   1173  PVLEPLSPTGLLELKPSSPLILKGRNLLPPAPGNSRLNYTVLIGSTPCTLT-VSETQLLC  1231
               ||+ +||+      |  + + + | ||         | +  |  | | +     +|  |
Sbjct:      1  PVITSISPSSG-PLSGGTEITITGSNL------GSGEDIKVTFGGTECDVVSQEASQIVC   53

Query:   1232  EAPNLTGQH----KVTVRAGGFEFSPGTLQVY  1259
                 + |          |++ ||   || |
Sbjct:     54  KTPPYANGGPQPVTVSLDGGGLSSSPVTFTYV   85
```

TABLE 12J

Domain Analysis of NOV12 gnl|Smart|smart00429, IPT, ig-like, plexins, transcription factors
(SEQ ID NO:116)
CD-Length = 93 residues, 100.0% aligned.
Score = 70.9 bits (172), Expect = 6e-13

```
Query:    885  DPKILKLSPETGPRQGGTRLTITGENLGLRFEDVRLGVRVGKVLCSPVESEYISAEQIVC   944
               ||  | ++||  +||    |||+|+ +||        |  + | |+  |+ + |+  |    |||
Sbjct:      1  DPVITRISPNSGPLSGGTRITLCGKNLDS-ISVVFVEVGVGEVPCTFLPSDV-SQTAIVC    58

Query:    945  EIGDASSVRAHDALVEVCVRDCSPHYRALSPKRFTFV   981
                 +          | | |   +         |   ||+|
Sbjct:     59  KTP-PYHNIPGSVPVRVEVGLRNGGVPG-EPSPFTYV    93
```

TABLE 12K

Domain Analysis of NOV12 gnl|Pfam|pfam01437, Plexin_repeat, Plexin repeat. A
cysteine rich repeat found in several different extracellular re-
ceptors. The function of the repeat is unknown. Three copies of the
repeat are found Plexin. Two copies of the repeat are found in ma-
hogany protein. A related C. elegans protein contains four
copies of the repeat. The Met receptor contains a single copy of
the repeat. The Pfam alignment shows 6 conserved cysteine residues
that may form three conserved disuiphide bridges. (SEQ ID NO:117)
CD-Length = 48 residues, 100.0% aligned
Score = 59.3 bits (142), Expect = 2e-09

```
Query:    532  SCVQYTSCELCLGSRDPHCGWCVLHSMCSRRDACERADEPQRFAADLLQCV   582
                +|  |+|||    || + || ||||        |+| +  | |      +  ++         |
Sbjct:      1  NCSQHTSCGSCLSAPDPGCGWCPSRKRCTRLEECSR---GEGWSQSQETCP    48
```

TABLE 12L

Domain Analysis of NOV12 gnl|Pfam|pfam01437, Plexin_repeat, Plexin repeat. A
cysteine rich repeat found in several different extracellular re-
ceptors. The function of the repeat is unknown. Three copies of
the
repeat are found Plexin. Two copies of the repeat are found in ma-
hogany protein. A related C. elegans protein contains four
copies of the repeat. The Met receptor contains a single copy of
the repeat. The Pfam alignment shows 6 conserved cysteine residues
that may form three conserved disulphide bridges. (SEQ ID NO:117)
CD-Length = 48 residues, 100.0% aligned
Score = 53.5 bits (127), Expect = 1e-07

TABLE 12L-continued

Domain Analysis of NOV12

```
Query:  681 NCSVHQSSCLSCVNGSFP-CHWCKYRHVCTHNVADCAFLEGRVNVSEDCP  729
            ||| | | ||++   | ||| | ||    +|+ ||    | ||
Sbjct:    1 NCSQHTS-CGSCLSAPDPGCGWCPSRKRCTRL-EECSRGEGWSQSQETCP   48
```

TABLE 12M

Domain Analysis of NOV12 gnl|Pfam|pfam01437, Plexin_repeat, Plexin repeat.
A cysteine rich repeat found in several different extracellular receptors. The function of the repeat is unknown. Three copies of the repeat are found Plexin. Two copies of the repeat are found in mahogany protein. A related *C. elegans* protein contains four copies of the repeat. The Met receptor contains a single copy of the repeat. The Pfam alignment shows 6 conserved cysteine residues that may form three conserved disulphide bridges. (SEQ ID NO:117)
CD-Length = 48 residues, 89.6% aligned
Score = 46.2 bits (108), Expect = 2e-05

```
Query:  835 RESCGLCLKADPRFECGWCVAERRCSLRHHCAADTPASWMHARHGSSRC  883
            ||| || | |  |||| + +||+    |    +              |
Sbjct:    5 HTSCGSCLSA-PDPGCGWCPSRKRCTRLEEC-----SRGEGWSQSQETC   47
```

TABLE 12N

Domain Analysis of NOV12 gnl|Smart|smart00423, PSI, domain found in Plexins, Semaphorins and Integrins (SEQ ID NO:118)
CD-Length = 47 residues, 89.4% aligned
Score = 44.3 bits (103), Expect = 6e-05

```
Query:  833 ALRESCGLCLKADPRFECGWCVAERRCSLRHHCAADTPASWMHA  876
            +   ||  ||| |   + | || ++ ||+    | +      +|
Sbjct:    3 SAYTSCSECLLARDPY-CAWCSSQGRCTSGERCDS-LRQNWSSG   44
```

Plexin is a type I membrane protein which was identified in Xenopus nervous system by hybridoma technique. Molecular cloning studies demonstrated that the extracellular segment of the plexin protein possesses three internal repeats of cysteine cluster which are homologous to the cysteine-rich domain of the c-met proto-oncogene protein product. A cell aggregation test revealed that the plexin protein mediated cell adhesion via a homophilic binding mechanism, in the presence of calcium ions. Plexin was expressed in the neuronal elements composing particular neuron circuits in Xenopus CNS and PNS. These findings indicate that plexin is a new member of the Ca(2+)-dependent cell adhesion molecules, and suggest that the molecule plays an important role in neuronal cell contact and neuron network formation.

In the developing nervous system axons navigate with great precision over large distances to reach their target areas. Chemorepulsive signals such as the semaphorins play an essential role in this process. The effects of one of these repulsive cues, semaphorin 3A (Sema3A), are mediated by the membrane protein neuropilin-1 (Npn-1). Recent work has shown that neuropilin-1 is essential but not sufficient to form functional Sema3A receptors and indicates that additional components are required to transduce signals from the cell surface to the cytoskeleton. Members of the plexin family interact with the neuropilins and act as co-receptors for Sema3A. Neuropilin/plexin interaction restricts the binding specificity of neuropilin-1 and allows the receptor complex to discriminate between two different semaphorins. Deletion of the highly conserved cytoplasmic domain of Plexin-A1 or -A2 creates a dominant negative Sema3A receptor that renders sensory axons resistant to the repulsive effects of Sema3A when expressed in sensory ganglia. These data suggest that functional semaphorin receptors contain plexins as signal-transducing and neuropilins as ligand-binding subunits.

Physiologic SEMA3A receptors consist of NRP1/PLXN1 complexes. Two semaphorin-binding proteins, plexin-1 (PLXN1) and neuropilin-1 (NRP1; 602069), form a stable complex. While SEMA3A binding to NRP1 does not alter nonneuronal cell morphology, SEMA3A interaction with NRP1/PLXN1 complexes induces adherent cells to round up. Expression of a dominant-negative PLXN1 in sensory neurons blocked SEMA3A-induced growth cone collapse. SEMA3A treatment led to the redistribution of growth cone NRP1 and PLXN1 into clusters.

The semaphorin family of proteins constitute one of the major cues for axonal guidance. The prototypic member of this family is Sema3A, previously designated semD/III or collapsin-1. Sema3A acts as a diffusible, repulsive guidance cue in vivo for the peripheral projections of embryonic dorsal root ganglion neurons. Sema3A binds with high affinity to neuropilin-1 on growth cone filopodial tips.

Although neuropilin-I is required for Sema3A action, it is incapable of transmitting a Sema3A signal to the growth cone interior. Instead, the Sema3A/neuropilin-1 complex interacts with another transmembrane protein, plexin, on the surface of growth cones. Certain semaphorins, other than Sema3A, can bind directly to plexins. The intracellular domain of plexin is responsible for initiating the signal transduction cascade leading to growth cone collapse, axon repulsion, or growth cone turning. This intracellular cascade involves the monomeric G-protein, Rac1, and a family of neuronal proteins, the CRMPs. Rad1 is likely to be involved in semaphorin-induced rearrangements of the actin cytoskeleton, but how plexin controls Rac1 activity is not known. Vertebrate CRMPs are homologous to the *Caenorhabditis elegans* unc-33 protein, which is required for proper axon morphology in worms. CRMPs are essential for Sema3A-induced, neuropilin-plexin-mediated growth cone collapse, but the molecular interactions of growth cone CRMPs are not well defined. Mechanistic aspects of plexin-based signaling for semaphorin guidance cues may have implications for other axon guidance events and for the basis of growth cone motility.

In *Drosophila*, plexin A is a functional receptor for semaphorin-1a. The human plexin gene family comprises at least nine members in four subfamilies. Plexin-B1 is a receptor for the transmembrane semaphorin Sema4D (CD100), and plexin-C1 is a receptor for the GPI-anchored semaphorin Sema7A (Sema-K1). Secreted (class 3) semaphorins do not bind directly to plexins, but rather plexins associate with neuropilins, coreceptors for these semaphorins. Plexins are widely expressed: in neurons, the expression of a truncated plexin-A1 protein blocks axon repulsion by Sema3A. The cytoplasmic domain of plexins associates with a tyrosine kinase activity. Plexins may also act as ligands mediating repulsion in epithelial cells in vitro. Thus, plexins are receptors for multiple (and perhaps all) classes of semaphorins, either alone or in combination with neuropilins, and trigger a novel signal transduction pathway controlling cell repulsion.

In addition, recent studies have identified semaphorins and their receptors as putative molecular cues involved in olfactory pathfinding, plasticity and regeneration. The semaphorins comprise a large family of secreted and transmembrane axon guidance proteins, being either repulsive or attractive in nature. Neuropilins were shown to serve as receptors for secreted class 3 semaphorins, whereas members of the plexin family are receptors for class 1 and V (viral) semaphorins.

The disclosed NOV12 nucleic acid of the invention encoding a Plexin-1-like protein includes the nucleic acid whose sequence is provided in Table 12A or a fragment thereof. The invention also includes a mutant or variant nucleic acid any of whose bases may be changed from the corresponding base shown in Table 12A while still encoding a protein that maintains its Plexin-1-like activities and physiological functions, or a fragment of such a nucleic acid. The invention further includes nucleic acids whose sequences are complementary to those just described, including nucleic acid fragments that are complementary to any of the nucleic acids just described. The invention additionally includes nucleic acids or nucleic acid fragments, or complements thereto, whose structures include chemical modifications. Such modifications include, by way of nonlimiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject. In the mutant or variant nucleic acids, and their complements, up to about 29 percent of the bases may be so changed.

The disclosed NOV12 protein of the invention includes the Plexin-1-like protein whose sequence is provided in Table 12B. The invention also includes a mutant or variant protein any of whose residues may be changed from the corresponding residue shown in Table 12B, while still encoding a protein that maintains its Plexin-1-like activities and physiological functions, or a functional fragment thereof. In the mutant or variant protein, up to about 29 percent of the residues may be so changed.

The protein similarity information, expression pattern, and map location for the plexin-1-like protein and the NOV12 protein disclosed herein suggest that this plexin-1-like protein may have important structural and/or physiological functions characteristic of the mannosidase protein family. Therefore, the nucleic acids and proteins of the invention are useful in potential diagnostic and therapeutic applications and as a research tool. These applications include serving as a specific or selective nucleic acid or protein diagnostic and/or prognostic marker, wherein the presence or amount of the nucleic acid or the protein are to be assessed, as well as potential therapeutic applications such as the following: (i) a protein therapeutic, (ii) a small molecule drug target, (iii) an antibody target (therapeutic, diagnostic, drug targeting/cytotoxic antibody), (iv) a nucleic acid useful in gene therapy (gene delivery/gene ablation), and (v) a composition promoting tissue regeneration in vitro and in vivo (vi) biological defense weapon.

The NOV12 nucleic acids and proteins of the invention are useful in potential diagnostic and therapeutic applications implicated in various diseases and disorders described below and/or other pathologies. For example, the compositions of the present invention will have efficacy for treatment of patients suffering from AIDS, cancer therapy, treatment of Neurologic diseases, Brain and/or autoimmune disorders like encephalomyelitis, neurodegenerative disorders, Alzheimer's Disease, Parkinson's Disorder, immune disorders, and hematopoietic disorders, endocrine diseases, muscle disorders, inflammation and wound repair, bacterial, fungal, protozoal and viral infections (particularly infections caused by HIV-1 or HIV-2), pain, cancer (including but not limited to Neoplasm; adenocarcinoma; lymphoma; prostate cancer; uterus cancer), anorexia, bulimia, asthma, Parkinson's disease, acute heart failure, hypotension, hypertension, urinary retention, osteoporosis, Crohn's disease; multiple sclerosis; and Treatment of Albright Hereditary Ostoeodystrophy, angina pectoris, myocardial infarction, ulcers, asthma, allergies, benign prostatic hypertrophy, and psychotic and neurological disorders, including anxiety, schizophrenia, manic depression, delirium, dementia, severe mental retardation and dyskinesias, such as Huntington's disease or Gilles de la Tourette syndrome, and/or other pathologies/disorders. The NOV12 nucleic acid, or fragments thereof, may further be useful in diagnostic applications, wherein the presence or amount of the nucleic acid or the protein are to be assessed.

NOV12 nucleic acids and polypeptides are further useful in the generation of antibodies that bind immunospecifically to the novel substances of the invention for use in therapeutic or diagnostic methods. These antibodies may be generated according to methods known in the art, using prediction from hydrophobicity charts, as described in the "Anti-NOVX Antibodies" section below. For example the disclosed NOV12 protein have multiple hydrophilic regions, each of which can be used as an immunogen. This novel protein also has value in development of powerful assay system for functional analysis of various human disorders, which will help in understanding of pathology of the disease and development of new drug targets for various disorders.

NOVX Nucleic Acids and Polypeptides

One aspect of the invention pertains to isolated nucleic acid molecules that encode NOVX polypeptides or biologically active portions thereof. Also included in the invention are nucleic acid fragments sufficient for use as hybridization probes to identify NOVX-encoding nucleic acids (e.g., NOVX mRNAs) and fragments for use as PCR primers for the amplification and/or mutation of NOVX nucleic acid molecules. As used herein, the term "nucleic acid molecule" is intended to include DNA molecules (e.g., cDNA or genomic DNA), RNA molecules (e.g., mRNA), analogs of the DNA or RNA generated using nucleotide analogs, and derivatives, fragments and homologs thereof. The nucleic acid molecule may be single-stranded or double-stranded, but preferably is comprised double-stranded DNA.

An NOVX nucleic acid can encode a mature NOVX polypeptide. As used herein, a "mature" form of a polypeptide or protein disclosed in the present invention is the product of a naturally occurring polypeptide or precursor form or proprotein. The naturally occurring polypeptide, precursor or proprotein includes, by way of nonlimiting example, the full-length gene product, encoded by the corresponding gene. Alternatively, it may be defined as the polypeptide, precursor or proprotein encoded by an ORF described herein. The product "mature" form arises, again by way of nonlimiting example, as a result of one or more naturally occurring processing steps as they may take place within the cell, or host cell, in which the gene product arises. Examples of such processing steps leading to a "mature" form of a polypeptide or protein include the cleavage of the N-terminal methionine residue encoded by the initiation codon of an ORF, or the proteolytic cleavage of a signal peptide or leader sequence. Thus a mature form arising from a precursor polypeptide or protein that has residues 1 to N, where residue 1 is the N-terminal methionine, would have residues 2 through N remaining after removal of the N-terminal methionine. Alternatively, a mature form arising from a precursor polypeptide or protein having residues 1 to N, in which an N-terminal signal sequence from residue 1 to residue M is cleaved, would have the residues from residue M+1 to residue N remaining. Further as used herein, a "mature" form of a polypeptide or protein may arise from a step of post-translational modification other than a proteolytic cleavage event. Such additional processes include, by way of non-limiting example, glycosylation, myristoylation or phosphorylation. In general, a mature polypeptide or protein may result from the operation of only one of these processes, or a combination of any of them.

The term "probes", as utilized herein, refers to nucleic acid sequences of variable length, preferably between at least about 10 nucleotides (nt), 100 nt, or as many as approximately, e.g., 6,000 nt, depending upon the specific use. Probes are used in the detection of identical, similar, or complementary nucleic acid sequences. Longer length probes are generally obtained from a natural or recombinant source, are highly specific, and much slower to hybridize than shorter-length oligomer probes. Probes may be single- or double-stranded and designed to have specificity in PCR, membrane-based hybridization technologies, or ELISA-like technologies.

The term "isolated" nucleic acid molecule, as utilized herein, is one, which is separated from other nucleic acid molecules which are present in the natural source of the nucleic acid. Preferably, an "isolated" nucleic acid is free of sequences which naturally flank the nucleic acid (i.e., sequences located at the 5'- and 3'-termini of the nucleic acid) in the genomic DNA of the organism from which the nucleic acid is derived. For example, in various embodiments, the isolated NOVX nucleic acid molecules can contain less than about 5 kb, 4 kb, 3 kb, 2 kb, 1 kb, 0.5 kb or 0.1 kb of nucleotide sequences which naturally flank the nucleic acid molecule in genomic DNA of the cell/tissue from which the nucleic acid is derived (e.g., brain, heart, liver, spleen, etc.). Moreover, an "isolated" nucleic acid molecule, such as a cDNA molecule, can be substantially free of other cellular material or culture medium when produced by recombinant techniques, or of chemical precursors or other chemicals when chemically synthesized.

A nucleic acid molecule of the invention, e.g., a nucleic acid molecule having the nucleotide sequence SEQ ID NOS:1, 3, 5, 7, 9, 11, 13, 15, 17, 19, 21, 23, 25, 27, 29, 31, and 217, or a complement of this aforementioned nucleotide sequence, can be isolated using standard molecular biology techniques and the sequence information provided herein. Using all oraportion of the nucleic acid sequence of SEQ ID NOS:1, 3, 5, 7, 9, 11, 13, 15, 17, 19, 21, 23, 25, 27, 29, 31, and 217 as a hybridization probe, NOVX molecules can be isolated using standard hybridization and cloning techniques (e.g., as described in Sambrook, et al., (eds.), MOLECULAR CLONING: A LABORATORY MANUAL $2^{nd}$ Ed., Cold Spring Harbor Laboratory Press, Cold Spring Harbor, N.Y., 1989; and Ausubel, et al., (eds.), CURRENT PROTOCOLS IN MOLECULAR BIOLOGY, John Wiley & Sons, New York, N.Y., 1993.)

A nucleic acid of the invention can be amplified using cDNA, mRNA or alternafively, genomic DNA, as a template and appropriate oligonucleotide primers according to standard PCR amplification techniques. The nucleic acid so amplified can be cloned into an appropriate vector and characterized by DNA sequence analysis. Furthermore, oligonucleotides corresponding to NOVX nucleotide sequences can be prepared by standard synthetic techniques, e.g., using an automated DNA synthesizer.

As used herein, the term "oligonucleotide" refers to a series of linked nucleotide residues, which oligonucleotide has a sufficient number of nucleotide bases to be used in a PCR reaction. A short oligonucleotide sequence may be based on, or designed from, a genomic or cDNA sequence and is used to amplify, confirm, or reveal the presence of an identical, similar or complementary DNA or RNA in a particular cell or tissue. Oligonucleotides comprise portions of a nucleic acid sequence having about 10 nt, 50 nt, or 100 nt in length, preferably about 15 nt to 30 nt in length. In one embodiment of the invention, an oligonucleotide comprising a nucleic acid molecule less than 100 nt in length would further comprise at least 6 contiguous nucleotides SEQ ID NOS:1, 3, 5, 7, 9, 11, 13, 15, 17, 19, 21, 23, 25, 27, 29, 31, and 217, or a complement thereof. Oligonucleotides may be chemically synthesized and may also be used as probes.

In another embodiment, an isolated nucleic acid molecule of the invention comprises a nucleic acid molecule that is a complement of the nucleotide sequence shown in SEQ ID NOS:1, 3, 5, 7, 9, 11, 13, 15, 17, 19, 21, 23, 25, 27, 29, 31, and 217, or a portion of this nucleotide sequence (e.g., a fragment that can be used as a probe or primer or a fragment encoding a biologically-active portion of an NOVX polypeptide). A nucleic acid molecule that is complementary to the nucleotide sequence shown SEQ ID NOS:1, 3, 5, 7, 9, 11, 13, 15, 17, 19, 21, 23, 25, 27, 29, 31, or 217 is one that is sufficiently complementary to the nucleotide sequence shown SEQ ID NOS:1, 3, 5, 7, 9, 11, 13, 15, 17, 19, 21, 23, 25, 27, 29, 31, or 217 that it can hydrogen bond with little or no mismatches to the nucleotide sequence shown SEQ ID NOS:1, 3, 5, 7, 9, 11, 13, 15, 17, 19, 21, 23, 25, 27, 29, 31, and 217, thereby forming a stable duplex.

As used herein, the term "complementary" refers to Watson-Crick or Hoogsteen base pairing between nucleotides units of a nucleic acid molecule, and the term "binding" means the physical or chemical interaction between two polypeptides or compounds or associated polypeptides or compounds or combinations thereof. Binding includes ionic, non-ionic, van der Waals, hydrophobic interactions, and the like. A physical interaction can be either direct or indirect. Indirect interactions may be through or due to the effects of another polypeptide or compound. Direct binding refers to interactions that do not take place through, or due to, the effect of another polypeptide or compound, but instead are without other substantial chemical intermediates.

Fragments provided herein are defined as sequences of at least 6 (contiguous) nucleic acids or at least 4 (contiguous) amino acids, a length sufficient to allow for specific hybridization in the case of nucleic acids or for specific recognition of an epitope in the case of amino acids, respectively, and are at most some portion less than a full length sequence. Fragments may be derived from any contiguous portion of a nucleic acid or amino acid sequence of choice. Derivatives are nucleic acid sequences or amino acid sequences formed from the native compounds either directly or by modification or partial substitution. Analogs are nucleic acid sequences or amino acid sequences that have a structure similar to, but not identical to, the native compound but differs from it in respect to certain components or side chains. Analogs may be synthetic or from a different evolutionary origin and may have a similar or opposite metabolic activity compared to wild type. Homologs are nucleic acid sequences or amino acid sequences of a particular gene that are derived from different species.

Derivatives and analogs may be full length or other than full length, if the derivative or analog contains a modified nucleic acid or amino acid, as described below. Derivatives or analogs of the nucleic acids or proteins of the invention include, but are not limited to, molecules comprising regions that are substantially homologous to the nucleic acids or proteins of the invention, in various embodiments, by at least about 70%, 80%, or 95% identity (with a preferred identity of 80–95%) over a nucleic acid or amino acid sequence of identical size or when compared to an aligned sequence in which the alignment is done by a computer homology program known in the art, or whose encoding nucleic acid is capable of hybridizing to the complement of a sequence encoding the aforementioned proteins under stringent, moderately stringent, or low stringent conditions. See e.g. Ausubel, et al., CURRENT PROTOCOLS IN MOLECULAR BIOLOGY, John Wiley & Sons, New York, N.Y., 1993, and below.

A "homologous nucleic acid sequence" or "homologous amino acid sequence," or variations thereof, refer to sequences characterized by a homology at the nucleotide level or amino acid level as discussed above. Homologous nucleotide sequences encode those sequences coding for isoforms of NOVX polypeptides. Isoforms can be expressed in different tissues of the same organism as a result of, for example, alternative splicing of RNA. Alternatively, isoforms can be encoded by different genes. In the invention, homologous nucleotide sequences include nucleotide sequences encoding for an NOVX polypeptide of species other than humans, including, but not limited to: vertebrates, and thus can include, e.g., frog, mouse, rat, rabbit, dog, cat cow, horse, and other organisms. Homologous nucleotide sequences also include, but are not limited to, naturally occurring allelic variations and mutations of the nucleotide sequences set forth herein. A homologous nucleotide sequence does not, however, include the exact nucleotide sequence encoding human NOVX protein. Homologous nucleic acid sequences include those nucleic acid sequences that encode conservative amino acid substitutions (see below) in SEQ ID NOS:1, 3, 5, 7, 9, 11, 13, 15, 17, 19, 21, 23, 25, 27, 29, 31, and 217, as well as a polypeptide possessing NOVX biological activity. Various biological activities of the NOVX proteins are described below.

An NOVX polypeptide is encoded by the open reading frame ("ORF") of an NOVX nucleic acid. An ORF corresponds to a nucleotide sequence that could potentially be translated into a polypeptide. A stretch of nucleic acids comprising an ORF is uninterrupted by a stop codon. An ORF that represents the coding sequence for a full protein begins with an ATG "start" codon and terminates with one of the three "stop" codons, namely, TAA, TAG, or TGA. For the purposes of this invention, an ORF may be any part of a coding sequence, with or without a start codon, a stop codon, or both. For an ORF to be considered as a good candidate for coding for a boniafide cellular protein, a minimum size requirement is often set, e.g., a stretch of DNA that would encode a protein of 50 amino acids or more.

The nucleotide sequences determined from the cloning of the human NOVX genes allows for the generation of probes and primers designed for use in identifying and/or cloning NOVX homologues in other cell types, e.g. from other tissues, as well as NOVX homologues from other vertebrates. The probe/primer typically comprises substantially purified oligonucleotide. The oligonucleotide typically comprises a region of nucleotide sequence that hybridizes under stringent conditions to at least about 12, 25, 50, 100, 150, 200, 250, 300, 350 or 400 consecutive sense strand nucleotide sequence SEQ ID NOS:1, 3, 5, 7, 9, 11, 13, 15, 17, 19, 21, 23, 25, 27, 29, 31, or 217; or an anti-sense strand nucleotide sequence of SEQ ID NOS:1, 3, 5, 7, 9, 11, 13, 15, 17, 19, 21, 23, 25, 27, 29, 31, or 217; or of a naturally occurring mutant of SEQ ID NOS:1, 3, 5, 7, 9, 11, 13, 15, 17, 19, 21, 23, 25, 27, 29, 31, and 217.

Probes based on the human NOVX nucleotide sequences can be used to detect transcripts or genomic sequences encoding the same or homologous proteins. In various embodiments, the probe further comprises a label group attached thereto, e.g. the label group can be a radioisotope, a fluorescent compound, an enzyme, or an enzyme co-factor. Such probes can be used as a part of a diagnostic test kit for identifying cells or tissues which mis-express an NOVX protein, such as by measuring a level of an NOVX-encoding nucleic acid in a sample of cells from a subject e.g., detecting NOVX mRNA levels or determining whether a genomic NOVX gene has been mutated or deleted.

"A polypeptide having a biologically-active portion of an NOVX polypeptide" refers to polypeptides exhibiting activity similar, but not necessarily identical to, an activity of a polypeptide of the invention, including mature forms, as measured in a particular biological assay, with or without dose dependency. A nucleic acid fragment encoding a "biologically-active portion of NOVX" can be prepared by isolating a portion SEQ ID NOS:1, 3, 5, 7, 9, 11, 13, 15, 17, 19, 21, 23, 25, 27, 29, 31, or 217, that encodes a polypeptide having an NOVX biological activity (the biological activities of the NOVX proteins are described below), expressing the encoded portion of NOVX protein (e.g., by recombinant expression ini vitro) and assessing the activity of the encoded portion of NOVX.

NOVX Nucleic Acid and Polypeptide Variants

The invention further encompasses nucleic acid molecules that differ from the nucleotide sequences shown in SEQ ID NOS:1, 3, 5, 7, 9, 11, 13, 15, 17, 19, 21, 23, 25, 27, 29, 31, and 217 due to degeneracy of the genetic code and thus encode the same NOVX proteins as that encoded by the nucleotide sequences shown in SEQ ID NOS:1, 3, 5, 7, 9, 11, 13, 15, 17, 19, 21, 23, 25, 27, 29, 31, and 217. In another embodiment, an isolated nucleic acid molecule of the invention has a nucleotide sequence encoding a protein having an amino acid sequence shown in SEQ ID NOS:2, 4, 6, 8, 10, 12, 14, 16, 18, 20, 22, 24, 26, 28, 30, 32, or 218.

In addition to the human NOVX nucleotide sequences shown in SEQ ID NOS:1, 3, 5, 7, 9, 11, 13, 15, 17, 19, 21, 23, 25, 27, 29, 31, and 217, it will be appreciated by those skilled in the art that DNA sequence polymorphisms that lead to changes in the amino acid sequences of the NOVX polypeptides may exist within a population (e.g., the human population). Such genetic polymorphism in the NOVX genes may exist among individuals within a population due to natural allelic variation. As used herein, the termns "gene" and "recombinant gene" refer to nucleic acid molecules comprising an open reading frame (ORF) encoding an NOVX protein, preferably a vertebrate NOVX protein. Such natural allelic variations can typically result in 1–5% variance in the nucleotide sequence of the NOVX genes. Any and all such nucleotide variations and resulting amino acid polymorphisms in the NOVX polypeptides, which are the result of natural allelic variation and that do not alter the functional activity of the NOVX polypeptides, are intended to be within the scope of the invention.

Moreover, nucleic acid molecules encoding NOVX proteins from other species, and thus that have a nucleotide sequence that differs from the human SEQ ID NOS:1, 3, 5, 7, 9, 11, 13, 15, 17, 19, 21, 23, 25, 27, 29, 31, and217 are intended to be withinthe scope of the invention. Nucleic acid molecules corresponding to natural allelic variants and homologues of the NOVX cDNAs of the invention can be isolated based on their homology to the human NOVX nucleic acids disclosed herein using the human cDNAs, or a portion thereof, as a hybridization probe according to standard hybridization techniques under stringent hybridization conditions.

Accordingly, in another embodiment, an isolated nucleic acid molecule of the invention is at least 6 nucleotides in length and hybridizes under stringent conditions to the nucleic acid molecule comprising the nucleotide sequence of SEQ ID NOS:1, 3, 5, 7, 9, 11, 13, 15, 17, 19, 21, 23, 25, 27, 29, 31, and 217. In another embodiment, the nucleic acid is at least 10, 25, 50, 100, 250, 500, 750, 1000, 1500, or 2000 or more nucleotides in length. In yet another embodiment, an isolated nucleic acid molecule of the invention hybridizes to the coding region. As used herein, the term "hybridizes under stringent conditions" is intended to describe conditions for hybridization and washing under which nucleotide sequences at least 60% homologous to each other typically remain hybridized to each other.

Homologs (i.e., nucleic acids encoding NOVX proteins derived from species other than human) or other related sequences (e.g., paralogs) can be obtained by low, moderate or high stringency hybridization with all or a portion of the particular human sequence as a probe using methods well known in the art for nucleic acid hybridization and cloning.

As used herein, the phrase "stringent hybridization conditions" refers to conditions under which a probe, primer or oligonucleotide will hybridize to its target sequence, but to no other sequences. Stringent conditions are sequence-dependent and will be different in different circumstances. Longer sequences hybridize specifically at higher temperatures than shorter sequences. Generally, stringent conditions are selected to be about 5° C. lower than the thermal melting point (Tm) for the specific sequence at a defined ionic strength and pH. The Tm is the temperature (under defined ionic strength, pH and nucleic acid concentration) at which 50% of the probes complementary to the target sequence hybridize to the target sequence at equilibrium. Since the target sequences are generally present at excess, at Tm, 50% of the probes are occupied at equilibrium. Typically, stringent conditions will be those in which the salt concentration is less than about 1.0 M sodium ion, typically about 0.01 to 1.0 M sodium ion (or other salts) at pH 7.0 to 8.3 and the temperature is at least about 30° C. for short probes, primers or oligonucleotides (e.g., 10 nt to 50 nt) and at least about 60° C. for longer probes, primers and oligonucleotides. Stringent conditions may also be achieved with the addition of destabilizing agents, such as formamide.

Stringent conditions are known to those skilled in the art and can be found in Ausubel, et al., (eds.), CURRENT PROTOCOLS IN MOLECULAR BIOLOGY, John Wiley & Sons, N.Y. (1989), 6.3.1–6.3.6. Preferably, the conditions are such that sequences at least about 65%, 70%, 75%, 85%, 90%, 95%, 98%, or 99% homologous to each other typically remain hybridized to each other. A non-limiting example of stringent hybridization conditions are hybridization in a high salt buffer comprising 6×SSC, 50 mM Tris-HCl (pH 7.5), 1 mM EDTA, 0.02% PVP, 0.02% Ficoll, 0.02% BSA, and 500 mg/ml denatured salmon sperm DNA at 65° C., followed by one or more washes in 0.2×SSC, 0.01% BSA at 50° C. An isolated nucleic acid molecule of the invention that hybridizes under stringent conditions to the sequences SEQ ID NOS:1, 3, 5, 7, 9, 11, 13, 15, 17, 19, 21, 23, 25, 27, 29, 31, and 217, corresponds to a naturally-occurring nucleic acid molecule. As used herein, a "naturally-occurring" nucleic acid molecule refers to an RNA or DNA molecule having a nucleotide sequence that occurs in nature (e.g., encodes a natural protein).

In a second embodiment, a nucleic acid sequence that is hybridizable to the nucleic acid molecule comprising the nucleotide sequence of SEQ ID NOS:1, 3, 5, 7, 9, 11, 13, 15, 17, 19, 21, 23, 25, 27, 29, 31, and 217, or fragments, analogs or derivatives thereof, under conditions of moderate stringency is provided. A non-limiting example of moderate stringency hybridization conditions are hybridization in 6×SSC, 5× Denhardt's solution, 0.5% SDS and 100 mg/ml denatured salmon sperm DNA at 55° C., followed by one or more washes in 1×SSC, 0.1% SDS at 37° C. Other conditions of moderate stringency that may be used are well-known within the art. See, e.g., Ausubel, et al. (eds.), 1993, CURRENT PROTOCOLS IN MOLECULAR BIOLOGY, John Wiley & Sons, NY, and Kriegler, 1990; GENE TRANSFER AND EXPRESSION, A LABORATORY MANUAL, Stockton Press, NY.

In a third embodiment, a nucleic acid that is hybridizable to the nucleic acid molecule comprising the nucleotide sequences SEQ ID NOS:1, 3, 5, 7, 9, 11, 13, 15, 17, 19, 21, 23, 25, 27, 29, 31, and 217, or fragments, analogs or derivatives thereof, under conditions of low stringency, is provided. A non-limiting example of low stringency hybridization conditions are hybridization in 35% formamide, 5×SSC, 50 mM Tris-HCl (pH 7.5), 5 mM EDTA, 0.02% PVP, 0.02% Ficoll, 0.2% BSA, 100 mg/ml denatured salmon sperm DNA, 10% (wt/vol) dextran sulfate at 40° C., followed by one or more washes in 2×SSC, 25 mM Tris-HCl (pH 7.4), 5 mM EDTA, and 0.1% SDS at 50° C. Other conditions of low stringency that may be used are well known in the art (e.g., as employed for cross-species hybridizations). See, e.g., Ausubel, et al. (eds.), 1993, CURRENT PROTOCOLS IN MOLECULAR BIOLOGY, John Wiley & Sons, NY, and Kriegler, 1990, GENE TRANSFER AND EXPRESSION, A LABORATORY MANUAL, Stockton Press, NY; Shilo and Weinberg, 1981. *Proc Natl Acad Sci USA* 78: 6789–6792.

Conservative Mutations

In addition to naturally-occurring allelic variants of NOVX sequences that may exist in the population, the skilled artisan will further appreciate that changes can be introduced by mutation into the nucleotide sequences SEQ ID NOS:1, 3, 5, 7, 9, 11, 13, 15, 17, 19, 21, 23, 25, 27, 29, 31, and 217, thereby leading to changes in the amino acid sequences of the encoded NOVX proteins, without altering the functional ability of said NOVX proteins. For example, nucleotide substitutions leading to amino acid substitutions at "non-essential" amino acid residues can be made in the sequence SEQ ID NOS:2, 4, 6, 8, 10, 12, 14, 16, 18, 20, 22, 24, 26, 28, 30, 32, or 218. A "non-essential" amino acid residue is a residue that can be altered from the wild-type sequences of the NOVX proteins without altering their biological activity, whereas an "essential" amino acid residue is required for such biological activity. For example, amino acid residues that are conserved among the NOVX proteins of the invention are predicted to be particularly non-amenable to alteration. Amino acids for which conservative substitutions can be made are well-known within the art.

Another aspect of the invention pertains to nucleic acid molecules encoding NOVX proteins that contain changes in amino acid residues that are not essential for activity. Such NOVX proteins differ in amino acid sequence from SEQ ID NOS:1, 3, 5, 7, 9, 11, 13, 15, 17, 19, 21, 23, 25, 27, 29, 31, and 217 yet retain biological activity. In one embodiment, the isolated nucleic acid molecule comprises a nucleotide sequence encoding a protein, wherein the protein comprises an amino acid sequence at least about 45% homologous to the amino acid sequences SEQ ID NOS:2, 4, 6, 8, 10, 12, 14, 16, 18, 20, 22, 24, 26, 28, 30, 32, and 218. Preferably, the protein encoded by the nucleic acid molecule is at least about 60% homologous to SEQ ID NOS:2, 4, 6, 8, 10, 12, 14, 16, 18, 20, 22, 24, 26, 28, 30, 32, and 218; more preferably at least about 70% homologous SEQ ID NOS:2, 4, 6, 8, 10, 12, 14, 16, 18, 20, 22, 24, 26, 28, 30, 32, or 218; still more preferably at least about 80% homologous to SEQ ID NOS:2, 4, 6, 8, 10, 12, 14, 16, 18, 20, 22, 24, 26, 28, 30, 32, or 218; even more preferably at least about 90% homologous to SEQ ID NOS:2, 4, 6, 8, 10, 12, 14, 16, 18, 20, 22, 24, 26, 28, 30, 32, or 218; and most preferably at least about 95% homologous to SEQ ID NOS:2, 4, 6, 8, 10, 12, 14, 16, 18, 20, 22, 24, 26, 28, 30, 32, or 218.

An isolated nucleic acid molecule encoding an NOVX protein homologous to the protein of SEQ ID NOS:2, 4, 6, 8, 10, 12, 14, 16, 18, 20, 22, 24, 26, 28, 30, 32, or 218 can be created by introducing one or more nucleotide substitutions, additions or deletions into the nucleotide sequence of SEQ ID NOS:1, 3, 5, 7, 9, 11, 13, 15, 17, 19, 21, 23, 25, 27, 29, 31, and 217, such that one or more amino acid substitutions, additions or deletions are introduced into the encoded protein.

Mutations can be introduced into SEQ ID NOS:1, 3, 5, 7, 9, 11, 13, 15, 17, 19, 21, 23, 25, 27, 29, 31, and 217 by standard techniques, such as site-directed mutagenesis and PCR-mediated mutagenesis. Preferably, conservative amino acid substitutions are made at one or more predicted, non-essential amino acid residues. A "conservative amino acid substitution" is one in which the amino acid residue is replaced with an amino acid residue having a similar side chain. Families of amino acid residues having similar side chains have been defined within the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). Thus, a predicted non-essential amino acid residue in the NOVX protein is replaced with another amino acid residue from the same side chain family. Alternatively, in another embodiment, mutations can be introduced randomly along all or part of an NOVX coding sequence, such as by saturation mutagenesis, and the resultant mutants can be screened for NOVX biological activity to identify mutants that retain activity. Following mutagenesis SEQ ID NOS:1, 3, 5, 7, 9, 11, 13, 15, 17, 19, 21, 23, 25, 27, 29, 31, and 217, the encoded protein can be expressed by any recombinant technology known in the art and the activity of the protein can be determined.

The relatedness of amino acid families may also be determined based on side chain interactions. Substituted amino acids may be fully conserved "strong" residues or fully conserved "weak" residues. The "strong" group of conserved amino acid residues may be any one of the following groups: STA, NEQK, NHQK, NDEQ, QHRK, MILV, MILF, HY, FYW, wherein the single letter amino acid codes are grouped by those amino acids that may be substituted for each other. Likewise, the "weak" group of conserved residues may be any one of the following: CSA, ATV, SAG, STNK, STPA, SGND, SNDEQK, NDEQHK, NEQHRK, VLIM, HFY, wherein the letters within each group represent the single letter amino acid code.

In one embodiment, a mutant NOVX protein can be assayed for (i) the ability to form protein:protein interactions with other NOVX proteins, other cell-surface proteins, or biologically-active portions thereof, (ii) complex formation between a mutant NOVX protein and an NOVX ligand; or (iii) the ability of a mutant NOVX protein to bind to an intracellular target protein or biologically-active portion thereof; (e.g. avidin proteins).

In yet another embodiment, a mutant NOVX protein can be assayed for the ability to regulate a specific biological function (e.g., regulation of insulin release).

Antisense Nucleic Acids

Another aspect of the invention pertains to isolated anti sense nucleic acid molecules that are hybridizable to or complementary to the nucleic acid molecule comprising the nucleotide sequence of SEQ ID NOS:1, 3, 5,7, 9, 11, 13, 15, 17, 19, 21, 23, 25, 27, 29, 31, and 217, or fragments, analogs or derivatives thereof. An "anti sense" nucleic acid comprises a nucleotide sequence that is complementary to a "sense" nucleic acid encoding a protein (e.g., complementary to the coding strand of a double-stranded cDNA molecule or complementary to an mRNA sequence). In specific aspects, anti sense nucleic acid molecules are provided that comprise a sequence complementary to at least about 10, 25, 50, 100, 250 or 500 nucleotides or an entire NOVX coding strand, or to only a portion thereof. Nucleic acid molecules encoding fragments, homologs, derivatives and analogs of an NOVX protein of SEQ ID NOS:2, 4, 6, 8, 10, 12, 14, 16, 18, 20, 22, 24, 26, 28, 30, 32, or 218, or antisense nucleic acids complementary to an NOVX nucleic acid sequence of SEQ ID NOS:1, 3, 5, 7, 9, 11, 13, 15, 17, 19, 21, 23, 25, 27, 29, 31, and 217, are additionally provided.

In one embodiment, an antisense nucleic acid molecule is antisense to a "coding region" of the coding strand of a nucleotide sequence encoding an NOVX protein. The term "coding region" refers to the region of the nucleotide sequence comprising codons which are translated into amino acid residues. In another embodiment, the antisense nucleic acid molecule is antisense to a "noncoding region" of the coding strand of a nucleotide sequence encoding the NOVX protein. The term "noncoding region" refers to 5' and 3' sequences which flank the coding region that are not translated into amino acids (i.e., also referred to as 5' and 3' untranslated regions).

Given the coding strand sequences encoding the NOVX protein disclosed herein, antisense nucleic acids of the invention can be designed according to the rules of Watson and Crick or Hoogsteen base pairing. The antisense nucleic acid molecule can be complementary to the entire coding region of NOVX mRNA, but more preferably is an oligonucleotide that is anti sense to only a portion of the coding or noncoding region of NOVX mRNA. For example, the antisense oligonucleotide can be complementary to the region surrounding the translation start site of NOVX mRNA. An antisense oligonucleotide can be, for example, about 5, 10, 15, 20, 25, 30, 35, 40, 45 or 50 nucleotides in length. An antisense nucleic acid of the invention can be constructed using chemical synthesis or enzymatic ligation reactions using procedures known in the art. For example, an antisense nucleic acid (e.g., an antisense oligonucleotide) can be chemically synthesized using naturally-occurring nucleotides or variously modified nucleotides designed to increase the biological stability of the molecules or to increase the physical stability of the duplex formed between the antisense and sense nucleic acids (e.g., phosphorothioate derivatives and acridine substituted nucleotides can be used).

Examples of modified nucleotides that can be used to generate the antisense nucleic acid include: 5-fluorouracil, 5-bromouracil, 5-chlorouracil, 5-iodouracil, hypoxanthine, xanthine, 4-acetylcytosine, 5-(carboxyhydroxylmethyl) uracil, 5-carboxymethylaminomethyl-2-thiouridine, 5-carboxymethylaminomethyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N-6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid (v), 5-methyl-2-thiouracil, 3-(3-amino-3-N-2-carboxypropyl)uracil, (acp3) w, and 2,6-diaminopurine. Alternatively, the antisense nucleic acid can be produced biologically using an expression vector into which a nucleic acid has been subcloned in an antisense orientation (i.e., RNA transcribed from the inserted nucleic acid will be of an antisense orientation to a target nucleic acid of interest, described further in the following subsection).

The antisense nucleic acid molecules of the invention are typically administered to a subject or generated int situ such that they hybridize with or bind to cellular mRNA and/or genomic DNA encoding an NOVX protein to thereby inhibit expression of the protein (e.g., by inhibiting transcription and/or translation). The hybridization can be by conventional nucleotide complementarity to form a stable duplex, or, for example, in the case of an antisense nucleic acid molecule that binds to DNA duplexes, through specific interactions in the major groove of the double helix. An example of a route of administration of antisense nucleic acid molecules of the invention includes direct injection at a tissue site. Alternatively, antisense nucleic acid molecules can be modified to target selected cells and then administered systemically. For example, for systemic administration, antisense molecules can be modified such that they specifically bind to receptors or antigens expressed on a selected cell surface (e.g., by linking the antisense nucleic acid molecules to peptides or antibodies that bind to cell surface receptors or antigens). The antisense nucleic acid molecules can also be delivered to cells using the vectors described herein. To achieve sufficient nucleic acid molecules, vector constructs in which the antisense nucleic acid molecule is placed under the control of a strong pol II or pol III promoter are preferred.

In yet another embodiment, the antisense nucleic acid molecule of the invention is an α-anomeric nucleic acid molecule. An α-anomeric nucleic acid molecule forms specific double-stranded hybrids with complementary RNA in which, contrary to the usual β-units, the strands run parallel to each other. See, e.g., Gaultier, et al., 1987. *Nucl. Acids Res.* 15: 6625–6641. The antisense nucleic acid molecule can also comprise a 2'-o-methylribonucleotide (See, e.g., Inoue, et al. 1987. *Nucl. Acids Res.* 15: 6131–6148) or a chimeric RNA-DNA analogue (See, e.g., Inoue, et al., 1987. *FEBS Lett.* 215: 327–330.

Ribozymes and PNA Moieties

Nucleic acid modifications include, by way of non-limiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject.

In one embodiment, an antisense nucleic acid of the invention is a ribozyme. Ribozymes are catalytic RNA molecules with ribonuclease activity that are capable of cleaving a single-stranded nucleic acid, such as an mRNA, to which they have a complementary region. Thus, ribozymes (e.g., hammerhead ribozymes as described in Haselhoff and Gerlach 1988. *Nature* 334: 585–591) can be used to catalytically cleave NOVX mRNA transcripts to thereby inhibit translation of NOVX mRNA. A ribozyme having specificity for an NOVX-encoding nucleic acid can be designed based upon the nucleotide sequence ofan NOVX cDNA disclosed herein (i.e., SEQ ID NOS:1, 3, 5, 7, 9, 11, 13, 15, 17, 19, 21, 23, 25, 27, 29, 31, and 217). For example, a derivative of a *Tetrahymena* L-19 IVS RNA can be constructed in which the nucleotide sequence of the active site is complementary to the nucleotide sequence to be cleaved in an NOVX-encoding mRNA. See, e.g., U.S. Pat. No. 4,987,071 to Cech, et al. and U.S. Pat. No. 5,116, 742 to Cech, et al. NOVX mRNA can also be used to select a catalytic RNA having a specific ribonuclease activity from a pool of RNA molecules. See, e.g., Bartel et al., (1993) *Science* 261:1411–1418.

Alternatively, NOVX gene expression can be inhibited by targeting nucleotide sequences complementary to the regulatory region of the NOVX nucleic acid (e.g., the NOVX promoter and/or enhancers) to form triple helical structures that prevent transcription of the NOVX gene in target cells. See, e.g., Helene, 1991. *Anticancer Drug Des.* 6: 569–84; Helene, et al. 1992. *Ann. N.Y. Acad. Sci.* 660: 27–36; Maher, 1992. *Bioassays* 14: 807–15.

In various embodiments, the NOVX nucleic acids can be modified at the base moiety, sugar moiety or phosphate backbone to improve, e.g., the stability, hybridization, or solubility of the molecule. For example, the deoxyribose phosphate backbone of the nucleic acids can be modified to generate peptide nucleic acids. See, e.g., Hyrup, et al., 1996. *Bioorg Med Chem* 4: 5–23. As used herein, the terms "peptide nucleic acids" or "PNAs" refer to nucleic acid mimics (e.g., DNA mimics) in which the deoxyribose phosphate backbone is replaced by a pseudopeptide backbone and only the four natural nucleobases are retained. The neutral backbone of PNAs has been shown to allow for specific hybridization to DNA and RNA under conditions of low ionic strength. The synthesis of PNA oligomers can be performed using standard solid phase peptide synthesis protocols as described in Hyrup, et al., 1996. supra; Perry-O'Keefe, et al., 1996. *Proc. Natl. Acad. Sci. USA* 93: 14670–14675.

PNAs of NOVX can be used in therapeutic and diagnostic applications. For example, PNAs can be used as antisense or antigene agents for sequence-specific modulation of gene expression by, e.g., inducing transcription or translation arrest or inhibiting replication. PNAs of NOVX can also be used, for example, in the analysis of single base pair mutations in a gene (e.g., PNA directed PCR clamping; as artificial restriction enzymes when used in combination with other enzymes, e.g., $S_1$ nucleases (See, Hyrup, et al., 1996.supra); or as probes or primers for DNA sequence and hybridization (See, Hyrup, et al., 1996, supra; Perry-O'Keefe, et al., 1996. supra).

In another embodiment, PNAs of NOVX can be modified, e.g., to enhance their stability or cellular uptake, by attaching lipophilic or other helper groups to PNA, by the formation of PNA-DNA chimeras, or by the use of liposomes or other techniques of drug delivery known in the art. For example, PNA-DNA chimeras of NOVX can be generated that may combine the advantageous properties of PNA and DNA. Such chimeras allow DNA recognition enzymes (e.g., RNase H and DNA polymerases) to interact with the DNA portion while the PNA portion would provide high binding affinity and specificity. PNA-DNA chimeras can be linked using linkers of appropriate lengths selected in terms of base stacking, number of bonds between the nucleobases, and orientation (see, Hyrup, et al., 1996. supra). The synthesis of PNA-DNA chimeras can be performed as described in Hyrup, et al., 1996. supra and Finn, et al., 1996. *Nucl Acids Res* 24: 3357–3363. For example, a DNA chain can be synthesized on a solid support using standard phosphoramidite coupling chemistry, and modified nucleoside analogs, e.g., 5'-(4-methoxytrityl)amino-5'-deoxy-thymidine phosphoramidite, can be used between the PNA and the 5' end of DNA. See, e.g., Mag, et al., 1989. *Nucl Acid Res* 17: 5973–5988. PNA monomers are then coupled in a stepwise manner to produce a chimeric molecule with a 5' PNA segment and a 3' DNA segment. See, e.g., Finn, et al., 1996. supra. Alternatively, chimeric molecules can be synthesized with a 5' DNA segment and a 3' PNA segment. See, e.g., Petersen, et al., 1975. *Bioorg. Med. Chem. Lett.* 5: 1119–11124.

In other embodiments, the oligonuclcotide may include other appended groups such as peptides (e.g., for targeting host cell receptors int vivo), or agents facilitating transport across the cell membrane (see, e.g., Letsinger, et al., 1989. *Proc. Natl. Acad. Sci. US.A.* 86: 6553–6556; Lemaitre, et al., 1987. *Proc. Natl. Acad. Sci.* 84: 648–652; PCT Publication No. WO88/09810) or the blood-brain barrier (see, e.g., PCT Publication No. WO 89/10134). In addition, oligonucleotides can be modified with hybridization triggered cleavage agents (see, e.g., Krol, et al., 1988. *BioTechniques* 6:958–976) or intercalating agents (see, e.g., Zon, 1988. *Phant. Res.* 5: 539–549). To this end, the oligonucleotide may be conjugated to another molecule, e.g., a peptide, a hybridization triggered cross-linking agent, a transport agent, a hybridization-triggered cleavage agent, and the like.

NOVX Polypeptides

A polypeptide according to the invention includes a polypeptide including the amino acid sequence of NOVX polypeptides whose sequences are provided in SEQ ID NOS:2, 4, 6, 8, 10, 12, 14, 16, 18, 20, 22, 24, 26, 28, 30, 32, or 218. The invention also includes a mutant or variant protein any of whose residues may be changed from the corresponding residues shown in SEQ ID NOS:2, 4, 6, 8, 10, 12, 14, 16, 18, 20, 22, 24, 26, 28, 30, 32, or 218 while still encoding a protein that maintains its NOVX activities and physiological functions, or a functional fragment thereof.

In general, an NOVX variant that preserves NOVX-like function includes any variant in which residues at a particular position in the sequence have been substituted by other amino acids, and further include the possibility of inserting an additional residue or residues between two residues of the parent protein as well as the possibility of deleting one or more residues from the parent sequence. Any amino acid substitution, insertion, or deletion is encompassed by the invention. In favorable circumstances, the substitution is a conservative substitution as defined above.

One aspect of the invention pertains to isolated NOVX proteins, and biologically-active portions thereof, or derivatives, fragments, analogs or homologs thereof. Also provided are polypeptide fragments suitable for use as immunogens to raise anti-NOVX antibodies. In one embodiment, native NOVX proteins can be isolated from cells or tissue sources by an appropriate purification scheme using standard protein purification techniques. In another embodiment, NOVX proteins are produced by recombinant DNA techniques. Alternative to recombinant expression, an NOVX protein or polypeptide can be synthesized chemically using standard peptide synthesis techniques.

An "isolated" or "purified" polypeptide or protein or biologically-active portion thereof is substantially free of cellular material or other contaminating proteins from the cell or tissue source from which the NOVX protein is derived, or substantially free from chemical precursors or other chemicals when chemically synthesized. The language "substantially free of cellular material" includes preparations of NOVX proteins in which the protein is separated from cellular components of the cells from which it is isolated or recombinantly-produced. In one embodiment, the language "substantially free of cellular material" includes preparations of NOVX proteins having less than about 30% (by dry weight) of non-NOVX proteins (also referred to herein as a "contaminating protein"), more preferably less than about 20% of non-NOVX proteins, still more preferably less than about 10% of non-NOVX proteins, and most preferably less than about 5% of non-NOVX proteins. When the NOVX protein or biologically-active portion thereof is recombinantly-produced, it is also preferably substantially free of culture medium, i.e., culture medium represents less than about 20%, more preferably less than about 10%, and most preferably less than about 5% of the volume of the NOVX protein preparation.

The language "substantially free of chemical precursors or other chemicals" includes preparations of NOVX proteins in which the protein is separated from chemical precursors or other chemicals that are involved in the synthesis of the protein. In one embodiment, the language "substantially free of chemical precursors or other chemicals" includes preparations of NOVX proteins having less than about 30% (by dry weight) of chemical precursors or non-NOVX chemicals, more preferably less than about 20% chemical precursors or non-NOVX chemicals, still more preferably less than about 10% chemical precursors or non-NOVX chemicals, and most preferably less than about 5% chemical precursors or non-NOVX chemicals.

Biologically-active portions of NOVX proteins include peptides comprising amino acid sequences sufficiently homologous to or derived from the amino acid sequences of the NOVX proteins (e.g., the amino acid sequence shown in SEQ ID NOS:2, 4, 6, 8, 10, 12, 14, 16, 18, 20, 22, 24, 26, 28, 30, 32, or 218) that include fewer amino acids than the full-length NOVX proteins, and exhibit at least one activity of an NOVX protein. Typically, biologically-active portions comprise a domain or motif with at least one activity of the NOVX protein. A biologically-active portion of an NOVX protein can be a polypeptide which is, for example, 10, 25, 50, 100 or more amino acid residues in length.

Moreover, other biologically-active portions, in which other regions of the protein are deleted, can be prepared by recombinant techniques and evaluated for one or more of the functional activities of a native NOVX protein.

In an embodiment, the NOVX protein has an amino acid sequence shown SEQ ID NOS:2, 4, 6, 8, 10, 12, 14, 16, 18, 20, 22, 24, 26, 28, 30, 32, or 218. In other embodiments, the NOVX protein is substantially homologous to SEQ ID NOS:2, 4, 6, 8, 10, 12, 14, 16, 18, 20, 22, 24, 26, 28, 30, 32, or 218, and retains the functional activity of the protein of SEQ ID NOS:2, 4, 6, 8, 10, 12, 14, 16, 18, 20, 22, 24, 26, 28, 30, 32, or 218, yet differs in amino acid sequence due to natural allelic variation or mutagenesis, as described in detail, below. Accordingly, in another embodiment, the NOVX protein is a protein that comprises an amino acid sequence at least about 45% homologous to the amino acid sequence SEQ ID NOS:2, 4, 6, 8, 10, 12, 14, 16, 18, 20, 22, 24, 26, 28, 30, 32, or 218, and retains the functional activity of the NOVX proteins of SEQ ID NOS:2, 4, 6, 8, 10, 12, 14, 16, 18, 20, 22, 24, 26, 28, 30, 32, or 218.

Determining Homology Between Two or More Sequences

To determine the percent homology of two amino acid sequences or of two nucleic acids, the sequences are aligned for optimal comparison purposes (e.g., gaps can be introduced in the sequence of a first amino acid or nucleic acid sequence for optimal alignment with a second amino or nucleic acid sequence). The amino acid residues or nucleotides at corresponding amino acid positions or nucleotide positions are then compared. When a position in the first sequence is occupied by the same amino acid residue or nucleotide as the corresponding position in the second sequence, then the molecules are homologous at that position (i.e., as used herein amino acid or nucleic acid "homology" is equivalent to amino acid or nucleic acid "identity").

The nucleic acid sequence homology may be determined as the degree of identity between two sequences. The homology may be determined using computer programs known in the art, such as GAP software provided in the GCG program package. See, Needleman and Wunsch, 1970. *J Mol Biol* 48: 443–453. Using GCG GAP software with the following settings for nucleic acid sequence comparison: GAP creation penalty of 5.0 and GAP extension penalty of 0.3, the coding region of the analogous nucleic acid sequences referred to above exhibits a degree of identity preferably of at least 70%, 75%, 80%, 85%, 90%, 95%, 98%, or 99%, with the CDS (encoding) part of the DNA sequence shown in SEQ ID NOS:1, 3, 5, 7, 9, 11, 13, 15, 17, 19, 21, 23, 25, 27, 29, 31, and 217.

The term "sequence identity" refers to the degree to which two polynucleotide or polypeptide sequences are identical on a residue-by-residue basis over a particular region of comparison. The term "percentage of sequence identity" is calculated by comparing two optimally aligned sequences over that region of comparison, determining the number of positions at which the identical nucleic acid base (e.g., A, T, C, G, U, or I, in the case of nucleic acids) occurs in both sequences to yield the number of matched positions, dividing the number of matched positions by the total number of positions in the region of comparison (i.e., the window size), and multiplying the result by 100 to yield the percentage of sequence identity. The term "substantial identity" as used herein denotes a characteristic of a polynucleotide sequence, wherein the polynucleotide comprises a sequence that has at least 80 percent sequence identity, preferably at least 85 percent identity and often 90 to 95 percent sequence identity, more usually at least 99 percent sequence identity as compared to a reference sequence over a comparison region.

Chimeric and Fusion Proteins

The invention also provides NOVX chimeric or fusion proteins. As used herein, an NOVX "chimeric protein" or "fusion protein" comprises an NOVX polypeptide operatively-linked to a non-NOVX polypeptide. An "NOVX polypeptide" refers to a polypeptide having an amino acid sequence corresponding to an NOVX protein SEQ ID NOS:2, 4, 6, 8, 10, 12, 14, 16, 18, 20, 22, 24, 26, 28, 30, 32, or 218, whereas a "non-NOVX polypeptide" refers to a polypeptide having an amino acid sequence corresponding to a protein that is not substantially homologous to the NOVX protein, e.g., a protein that is different from the NOVX protein and that is derived from the same or a different organism. Within an NOVX fusion protein the NOVX polypeptide can correspond to all or a portion of an NOVX protein. In one embodiment, an NOVX fusion protein comprises at least one biologically-active portion of an NOVX protein. In another embodiment, an NOVX fusion protein comprises at least two biologically-active portions of an NOVX protein. In yet another embodiment, an NOVX fusion protein comprises at least three biologically-active portions of an NOVX protein. Within the fusion protein, the term "operatively-linked" is intended to indicate that the NOVX polypeptide and the non-NOVX polypeptide are fused in-frame with one another. The non-NOVX polypeptide can be fused to the N-terminus or C-terminus of the NOVX polypeptide.

In one embodiment, the fusion protein is a GST-NOVX fusion protein in which the NOVX sequences are fused to the C-terminus of the GST (glutathione S-transferase) sequences. Such fusion proteins can facilitate the purification of recombinant NOVX polypeptides.

In another embodiment, the fusion protein is an NOVX protein containing a heterologous signal sequence at its N-terminus. In certain host cells (e.g., mammalian host cells), expression and/or secretion of NOVX can be increased through use of a heterologous signal sequence.

In yet another embodiment, the fusion protein is an NOVX-immunoglobulin fusion protein in which the NOVX sequences are fused to sequences derived from a member of the immunoglobulin protein family. The NOVX-immunoglobulin fusion proteins of the invention can be incorporated into pharmaceutical compositions and administered to a subject to inhibit an interaction between an NOVX ligand and an NOVX protein on the surface of a cell, to thereby suppress NOVX-mediated signal transduction in vivo. The NOVX-immunoglobulin fusion proteins can be used to affect the bioavailability of an NOVX cognate ligand. Inhibition of the NOVX ligand/NOVX interaction may be useful therapeutically for both the treatment of proliferative and differentiative disorders, as well as modulating (e.g. promoting or inhibiting) cell survival. Moreover, the NOVX-immunoglobulin fusion proteins of the invention can be used as immunogens to produce anti-NOVX antibodies in a subject, to purify NOVX ligands, and in screening assays to identify molecules that inhibit the interaction of NOVX with an NOVX ligand.

An NOVX chimeric or fusion protein of the invention can be produced by standard recombinant DNA techniques. For example, DNA fragments coding for the different polypeptide sequences are ligated together in-frame in accordance with conventional techniques, e.g., by employing blunt-ended or stagger-ended termini for ligation, restriction enzyme digestion to provide for appropriate termini, filling-in of cohesive ends as appropriate, alkaline phosphatase treatment to avoid undesirable joining, and enzymatic ligation. In another embodiment, the fusion gene can be synthesized by conventional techniques including automated DNA synthesizers. Alternatively, PCR amplification of gene fragments can be carried out using anchor primers that give rise to complementary overhangs between two consecutive gene fragments that can subsequently be annealed and reamplified to generate a chimeric gene sequence (see, e.g., Ausubel, et al. (eds.) CURRENT PROTOCOLS IN MOLECULAR BIOLOGY, John Wiley & Sons, 1992). Moreover, many expression vectors are commercially available that already encode a fusion moiety (e.g., a GST polypeptide). An NOVX-encoding nucleic acid can be cloned into such an expression vector such that the fusion moiety is linked in-frame to the NOVX protein.

NOVX Agonists and Antagonists

The invention also pertains to variants of the NOVX proteins that function as either NOVX agonists (i.e., mimetics) or as NOVX antagonists. Variants of the NOVX protein can be generated by mutagenesis (e.g., discrete point mutation or truncation of the NOVX protein). An agonist of the NOVX protein can retain substantially the same, or a subset of, the biological activities of the naturally occurring form of the NOVX protein. An antagonist of the NOVX protein can inhibit one or more of the activities of the naturally occurring form of the NOVX protein by, for example, competitively binding to a downstream or upstream member of a cellular signaling cascade which includes the NOVX protein. Thus, specific biological effects can be elicited by treatment with a variant of limited function. In one embodiment, treatment of a subject with a variant having a subset of the biological activities of the naturally occurring form of the protein has fewer side effects in a subject relative to treatment with the naturally occurring form of the NOVX proteins.

Variants of the NOVX proteins that function as either NOVX agonists (i.e., mimetics) or as NOVX antagonists can be identified by screening combinatorial libraries of mutants (e.g., truncation mutants) of the NOVX proteins for NOVX protein agonist or antagonist activity. In one embodiment, a variegated library of NOVX variants is generated by combinatorial mutagenesis at the nucleic acid level and is encoded by a variegated gene library. A variegated library of NOVX variants can be produced by, for example, enzymatically ligating a mixture of synthetic oligonucleotides into gene sequences such that a degenerate set of potential NOVX sequences is expressible as individual polypeptides, or alternatively, as a set of larger fusion proteins (e.g., for phage display) containing the set of NOVX sequences therein. There are a variety of methods which can be used to produce libraries of potential NOVX variants from a degenerate oligonucleotide sequence. Chemical synthesis of a degenerate gene sequence can be performed in an automatic DNA synthesizer, and the synthetic gene then ligated into an appropriate expression vector. Use of a degenerate set of genes allows for the provision, in one mixture, of all of the sequences encoding the desired set of potential NOVX sequences. Methods for synthesizing degenerate oligonucleotides are well-known within the art. See, e.g., Narang, 1983. *Tetrahedron* 39: 3; Itakura, et al., 1984. *Annu. Rev. Biochem.* 53: 323; Itakura, et al., 1984. *Science* 198: 1056; Ike, et al., 1983. *Nucl. Acids Res.* 11: 477.

Polypeptide Libraries

In addition, libraries of fragments of the NOVX protein coding sequences can be used to generate a variegated population of NOVX fragments for screening and subsequent selection of variants of an NOVX protein. In one embodiment, a library of coding sequence fragments can be generated by treating a double stranded PCR fragment of an NOVX coding sequence with a nuclease under conditions wherein nicking occurs only about once per molecule, denaturing the double stranded DNA, renaturing the DNA to form double-stranded DNA that can include sense/antisense pairs from different nicked products, removing single stranded portions from reformed duplexes by treatment with $S_1$ nuclease, and ligating the resulting fragment library into an expression vector. By this method, expression libraries can be derived which encodes N-terminal and internal fragments of various sizes of the NOVX proteins.

Various techniques are known in the art for screening gene products of combinatorial libraries made by point mutations or truncation, and for screening cDNA libraries for gene products having a selected property. Such techniques are adaptable for rapid screening of the gene libraries generated by the combinatorial mutagenesis of NOVX proteins. The most widely used techniques, which are amenable to high throughput analysis, for screening large gene libraries typically include cloning the gene library into replicable expression vectors, transforming appropriate cells with the resulting library of vectors, and expressing the combinatorial genes under conditions in which detection of a desired activity facilitates isolation of the vector encoding the gene whose product was detected. Recursive ensemble mutagenesis (REM), a new technique that enhances the frequency of functional mutants in the libraries, can be used in combination with the screening assays to identify NOVX variants. See, e.g., Arkin and Yourvan, 1992. *Proc. Natl. Acad. Sci. USA* 89: 7811–7815; Delgrave, et al., 1993. *Protein Engineering* 6:327–331.

Anti-NOVX Antibodies

Also included in the invention are antibodies to NOVX proteins, or fragments of NOVX proteins. The term "antibody" as used herein refers to immunoglobulin molecules and immunologically active portions of immunoglobulin (Ig) molecules, i.e., molecules that contain an antigen binding site that specifically binds (immunoreacts with) an antigen. Such antibodies include, but are not limited to, polyclonal, monoclonal, chimeric, single chain, $F_{ab}$, $F_{ab'}$ and $F_{(ab')2}$ fragments, and an $F_{ab}$ expression library. In general, an antibody molecule obtained from humans relates to any of the classes IgG, IgM, IgA, IgE and IgD, which differ from one another by the nature of the heavy chain present in the molecule. Certain classes have subclasses as well, such as IgG$_1$, IgG$_2$, and others. Furthermore, in humans, the light chain may be a kappa chain or a lambda chain. Reference herein to antibodies includes a reference to all such classes, subclasses and types of human antibody species.

An isolated NOVX-related protein of the invention may be intended to serve as an antigen, or a portion or fragment thereof, and additionally can be used as an immunogen to generate antibodies that immunospecifically bind the antigen, using standard techniques for polyclonal and monoclonal antibody preparation. The full-length protein can be used or, alternatively, the invention provides antigenic peptide fragments of the antigen for use as immunogens. An antigenic peptide fragment comprises at least 6 amino acid residues of the amino acid sequence of the full length protein and encompasses an epitope thereof such that an antibody raised against the peptide forms a specific immune complex with the full length protein or with any fragment that contains the epitope. Preferably, the antigenic peptide comprises at least 10 amino acid residues, or at least 15 amino acid residues, or at least 20 amino acid residues, or at least 30 amino acid residues. Preferred epitopes encompassed by the antigenic peptide are regions of the protein that are located on its surface; commonly these are hydrophilic regions.

In certain embodiments of the invention, at least one epitope encompassed by the antigenic peptide is a region of NOVX-related protein that is located on the surface of the protein, e.g., a hydrophilic region. A hydrophobicity analysis of the human NOVX-related protein sequence will indicate which regions of a NOVX-related protein are particularly hydrophilic and, therefore, are likely to encode surface residues useful for targeting antibody production. As a means for targeting antibody production, hydropathy plots showing regions of hydrophilicity and hydrophobicity may be generated by any method well known in the art, including, for example, the Kyte Doolittle or the Hopp Woods methods, either with or without Fourier transformation. See, e.g., Hopp and Woods, 1981, *Proc. Nat. Acad. Sci. USA* 78: 3824–3828; Kyte and Doolittle 1982, *J. Mol. Biol.* 157: 105–142, each of which is incorporated herein by reference in its entirety. Antibodies that are specific for one or more domains within an antigenic protein, or derivatives, fragments, analogs or homologs thereof, are also provided herein.

A protein of the invention, or a derivative, fragment, analog, homolog or ortholog thereof, may be utilized as an immunogen in the generation of antibodies that immunospecifically bind these protein components.

Various procedures known within the art may be used for the production of polyclonal or monoclonal antibodies directed against a protein of the invention, or against derivatives, fragments, analogs homologs or orthologs thereof (see, for example, Antibodies: A Laboratory Manual, Harlow and Lane, 1988, Cold Spring Harbor Laboratory Press, Cold Spring Harbor, N.Y., incorporated herein by reference). Some of these antibodies are discussed below.

Polyclonal Antibodies

For the production of polyclonal antibodies, various suitable host animals (e.g., rabbit, goat, mouse or other mammal) may be immunized by one or more injections with the native protein, a synthetic variant thereof, or a derivative of the foregoing. An appropriate immunogenic preparation can contain, for example, the naturally occurring immunogenic protein, a chemically synthesized polypeptide representing the immunogenic protein, or a recombinantly expressed immunogenic protein. Furthermore, the protein may be conjugated to a second protein known to be immunogenic in the mammal being immunized. Examples of such immunogenic proteins include but are not limited to keyhole limpet hemocyanin, serum albumin, bovine thyroglobulin, and soybean trypsin inhibitor. The preparation can further include an adjuvant. Various adjuvants used to increase the immunological response include, but are not limited to, Freund's (complete and incomplete), mineral gels (e.g., aluminum hydroxide), surface active substances (e.g., lysolecithin, pluronic polyols, polyanions, peptides, oil emulsions, dinitrophenol, etc.), adjuvants usable in humans such as Bacille Calmette-Guerin and *Corynebacterium parvum*, or similar immunostimulatory agents. Additional examples of adjuvants which can be employed include MPL-TDM adjuvant (monophosphoryl Lipid A, synthetic trehalose dicorynomycolate).

The polyclonal antibody molecules directed against the immunogenic protein can be isolated from the mammal (e.g., from the blood) and further purified by well known techniques, such as affinity chromatography using protein A or protein G, which provide primarily the IgG fraction of immune serum. Subsequently, or alternatively, the specific antigen which is the target of the immunoglobulin sought, or an epitope thereof, may be immobilized on a column to purify the immune specific antibody by immunoaffinity chromatography. Purification of immunoglobulins is discussed, for example, by D. Wilkinson (The Scientist, published by The Scientist, Inc., Philadelphia Pa., Vol. 14, No. 8 (Apr. 17, 2000), pp. 25–28).

Monoclonal Antibodies

The term "monoclonal antibody" (MAb) or "monoclonal antibody composition", as used herein, refers to a population of antibody molecules that contain only one molecular species of antibody molecule consisting of a unique light chain gene product and a unique heavy chain gene product. In particular, the complementarity determining regions (CDRs) of the monoclonal antibody are identical in all the molecules of the population. MAbs thus contain an antigen binding site capable of immunoreacting with a particular epitope of the antigen characterized by a unique binding affinity for it.

Monoclonal antibodies can be prepared using hybridoma methods, such as those described by Kohler and Milstein, *Nature*, 256:495 (1975). In a hybridoma method, a mouse, hamster, or other appropriate host animal, is typically immunized with an immunizing agent to elicit lymphocytes that produce or are capable of producing antibodies that will specifically bind to the immunizing agent. Alternatively, the lymphocytes can be immunized in vitro.

The immunizing agent will typically include the protein antigen, a fragment thereof or a fusion protein thereof. Generally, either peripheral blood lymphocytes are used if cells of human origin are desired, or spleen cells or lymph node cells are used if non-human mammalian sources are desired. The lymphocytes are then fused with an immortalized cell line using a suitable fusing agent, such as polyethylene glycol, to form a hybridoma cell (Goding, MONOCLONAL ANTIBODIES: PRINCIPLES AND PRACTICE, Academic Press, (1986) pp. 59–103). Immortalized cell lines are usually transformed mammalian cells, particularly myeloma cells of rodent, bovine and human origin. Usually, rat or mouse myeloma cell lines are employed. The hybridoma cells can be cultured in a suitable culture medium that preferably contains one or more substances that inhibit the growth or survival of the unfused, immortalized cells. For example, if the parental cells lack the enzyme hypoxanthine guanine phosphoribosyl transferase (HGPRT or HPRT), the culture medium for the hybridomas typically will include hypoxanthine, aminopterin, and thymidine ("HAT medium"), which substances prevent the growth of HGPRT-deficient cells.

Preferred immortalized cell lines are those that fuse efficiently, support stable high level expression of antibody by the selected antibody-producing cells, and are sensitive to a medium such as HAT medium. More preferred immortalized cell lines are murine myeloma lines, which can be obtained, for instance, from the Salk Institute Cell Distribution Center, San Diego, Calif. and the American Type Culture Collection, Manassas, Va. Human myeloma and mouse-human heteromyeloma cell lines also have been described for the production of human monoclonal antibodies (Kozbor, J. Immunol., 133:3001 (1984); Brodeur et al., MONOCLONAL ANTIBODY PRODUCTION TECHNIQUES AND APPLICATIONS, Marcel Dekker, Inc., New York, (1987) pp. 51–63).

The culture medium in which the hybridoma cells are cultured can then be assayed for the presence of monoclonal antibodies directed against the antigen. Preferably, the binding specificity of monoclonal antibodies produced by the hybridoma cells is determined by immunoprecipitation or by an in vitro binding assay, such as radioimmunoassay (RIA) or enzyme-linked immunoabsorbent assay (ELISA). Such techniques and assays are known in the art. The binding affinity of the monoclonal antibody can, for example, be determined by the Scatchard analysis of Munson and Pollard, Anal. Biochem., 107:220 (1980). Preferably, antibodies having a high degree of specificity and a high binding affinity for the target antigen are isolated.

After the desired hybridoma cells are identified, the clones can be subcloned by limiting dilution procedures and grown by standard methods. Suitable culture media for this purpose include, for example, Dulbecco's Modified Eagle's Medium and RPMI-1640 medium. Alternatively, the hybridoma cells can be grown in vivo as ascites in a mammal.

The monoclonal antibodies secreted by the subclones can be isolated or purified from the culture medium or ascites fluid by conventional immunoglobulin purification procedures such as, for example, protein A-Sepharose, hydroxylapatite chromatography, gel electrophoresis, dialysis, or affinity chromatography.

The monoclonal antibodies can also be made by recombinant DNA methods, such as those described in U.S. Pat. No. 4,816,567. DNA encoding the monoclonal antibodies of the invention can be readily isolated and sequenced using conventional procedures (e.g., by using oligonucleotide probes that are capable of binding specifically to genes encoding the heavy and light chains of murine antibodies). The hybridoma cells of the invention serve as a preferred source of such DNA. Once isolated, the DNA can be placed into expression vectors, which are then transfected into host cells such as simian COS cells, Chinese hamster ovary (CHO) cells, or myeloma cells that do not otherwise produce immunoglobulin protein, to obtain the synthesis of monoclonal antibodies in the recombinant host cells. The DNA also can be modified, for example, by substituting the coding sequence for human heavy and light chain constant domains in place of the homologous murine sequences (U.S. Pat. No. 4,816,567; Morrison, Nature 368, 812–13 (1994)) or by covalently joining to the immunoglobulin coding sequence all or part of the coding sequence for a non-immunoglobulin polypeptide. Such a non-immunoglobulin polypeptide can be substituted for the constant domains of an antibody of the invention, or can be substituted for the variable domains of one antigen-combining site of an antibody of the invention to create a chimeric bivalent antibody.

Humanized Antibodies

The antibodies directed against the protein antigens of the invention can further comprise humanized antibodies or human antibodies. These antibodies are suitable for administration to humans without engendering an immune response by the human against the administered immunoglobulin. Humanized forms of antibodies are chimeric immunoglobulins, immunoglobulin chains or fragments thereof (such as Fv, Fab, Fab', F(ab')$_2$ or other antigen-binding subsequences of antibodies) that are principally comprised of the sequence of a human immunoglobulin, and contain minimal sequence derived from a non-human immunoglobulin. Humanization can be performed following the method of Winter and co-workers (Jones et al., Nature, 321:522–525 (1986); Riechmann et al., Nature, 332:323–327 (1988); Verhoeyen et al., Science, 239:1534–1536 (1988)), by substituting rodent CDRs or CDR sequences for the corresponding sequences of a human antibody. (See also U.S. Pat. No. 5,225,539.) In some instances, Fv framework residues of the human immunoglobulin are replaced by corresponding non-human residues. Humanized antibodies can also comprise residues which are found neither in the recipient antibody nor in the imported CDR or framework sequences. In general, the humanized antibody will comprise substantially all of at least one, and typically two, variable domains, in which all or substantially all of the CDR regions correspond to those of a non-human immunoglobulin and all or substantially all of the framework regions are those of a human immunoglobulin consensus sequence. The humanized antibody optimally also will comprise at least a portion of an immunoglobulin constant region (Fc), typically that of a human immunoglobulin (Jones et al., 1986; Riechmann et al., 1988; and Presta, Curr. Op. Struct. Biol., 2:593–596 (1992)).

Human Antibodies

Fully human antibodies relate to antibody molecules in which essentially the entire sequences of both the light chain and the heavy chain, including the CDRs, arise from human genes. Such antibodies are termed "human antibodies", or "fully human antibodies" herein. Human monoclonal antibodies can be prepared by the trioma technique; the human B-cell hybridoma technique (see Kozbor, et al., 1983 Immunol Today 4: 72) and the EBV hybridoma technique to produce human monoclonal antibodies (see Cole, et al., 1985 In: MONOCLONAL ANTIBODIES AND CANCER THERAPY, Alan R. Liss, Inc., pp. 77–96). Human monoclonal antibodies may be utilized in the practice of the present invention and may be produced by using human hybridomas (see Cote, et al., 1983. Proc Natl Acad Sci USA 80: 2026–2030) or by transforming human B-cells with Epstein Barr Virus in vitro (see Cole, et al., 1985 In: MONOCLONAL ANTIBODIES AND CANCER THERAPY, Alan R. Liss, Inc., pp. 77–96).

In addition, human antibodies can also be produced using additional techniques, including phage display libraries (Hoogenboom and Winter, J. Mol. Biol., 227:381 (1991); Marks et al., J. Mol. Biol., 222:581 (1991)). Similarly, human antibodies can be made by introducing human immunoglobulin loci into transgenic animals, e.g., mice in which the endogenous immunoglobulin genes have been partially or completely inactivated. Upon challenge, human antibody production is observed, which closely resembles that seen in humans in all respects, including gene rearrangement, assembly, and antibody repertoire. This approach is described, for example, in U.S. Pat. Nos. 5,545,807; 5,545, 806; 5,569,825; 5,625,126; 5,633,425; 5,661,016, and in Marks et al. (*Bio/Technology* 10, 779–783 (1992)); Lonberg et al. (*Nature* 368 856–859 (1994)); Morrison (*Nature* 368, 812–13 (1994)); Fishwild et al,(*Nature Biotechnology* 14, 845–51 (1996)); Neuberger (*Nature Biotechnology* 14, 826 (1996)); and Lonberg and Huszar (*Intern. Rev. Immunol.* 13 65–93 (1995)).

Human antibodies may additionally be produced using transgenic nonhuman animals which are modified so as to produce fully human antibodies rather than the animal's endogenous antibodies in response to challenge by an antigen. (See PCT publication WO94/02602). The endogenous genes encoding the heavy and light immunoglobulin chains in the nonhuman host have been incapacitated, and active loci encoding human heavy and light chain immunoglobulins are inserted into the host's genome. The human genes are incorporated, for example, using yeast artificial chromosomes containing the requisite human DNA segments. An animal which provides all the desired modifications is then obtained as progeny by crossbreeding intermediate transgenic animals containing fewer than the full complement of the modifications. The preferred embodiment of such a nonhuman animal is a mouse, and is termed the Xenomouse™ as disclosed in PCT publications WO 96/33735 and WO 96/34096. This animal produces B cells which secrete fully human immunoglobulins. The antibodies can be obtained directly from the animal after immunization with an immunogen of interest, as, for example, a preparation of a polyclonal antibody, or alternatively from immortalized B cells derived from the animal, such as hybridomas producing monoclonal antibodies. Additionally, the genes encoding the immunoglobulins with human variable regions can be recovered and expressed to obtain the antibodies directly, or can be further modified to obtain analogs of antibodies such as, for example, single chain Fv molecules.

An example of a method of producing a nonhuman host, exemplified as a mouse, lacking expression of an endogenous immunoglobulin heavy chain is disclosed in U.S. Pat. No. 5,939,598. It can be obtained by a method including deleting the J segment genes from at least one endogenous heavy chain locus in an embryonic stem cell to prevent rearrangement of the locus and to prevent formation of a transcript of a rearranged immunoglobulin heavy chain locus, the deletion being effected by a targeting vector containing a gene encoding a selectable marker; and producing from the embryonic stem cell a transgenic mouse whose somatic and germ cells contain the gene encoding the selectable marker.

A method for producing an antibody of interest, such as a human antibody, is disclosed in U.S. Pat. No. 5,916,771. It includes introducing an expression vector that contains a nucleotide sequence encoding a heavy chain into one mammalian host cell in culture, introducing an expression vector containing a nucleotide sequence encoding a light chain into another mammalian host cell, and fusing the two cells to form a hybrid cell. The hybrid cell expresses an antibody containing the heavy chain and the light chain.

In a further improvement on this procedure, a method for identifying a clinically relevant epitope on an immunogen, and a correlative method for selecting an antibody that binds immunospecifically to the relevant epitope with high affinity, are disclosed in PCT publication WO 99/53049.

$F_{ab}$ Fragments and Single Chain Antibodies

According to the invention, techniques can be adapted for the production of single-chain antibodies specific to an antigenic protein of the invention (see e.g., U.S. Pat. No. 4,946,778). In addition, methods can be adapted for the construction of $F_{ab}$ expression libraries (see e.g., Huse, et al., 1989 Science 246: 1275–1281) to allow rapid and effective identification of monoclonal $F_{ab}$ fragments with the desired specificity for a protein or derivatives, fragments, analogs or homologs thereof. Antibody fragments that contain the idiotypes to a protein antigen may be produced by techniques known in the art including, but not limited to: (i) an $F_{(ab')2}$ fragment produced by pepsin digestion of an antibody molecule; (ii) an $F_{ab}$ fragment generated by reducing the disulfide bridges of an $F_{(ab')2}$ fragment; (iii) an $F_{ab}$ fragment generated by the treatment of the antibody molecule with papain and a reducing agent and (iv) $F_v$ fragments.

Bispecific Antibodies

Bispecific antibodies are monoclonal, preferably human or humanized, antibodies that have binding specificities for at least two different antigens. In the present case, one of the binding specificities is for an antigenic protein of the invention. The second binding target is any other antigen, and advantageously is a cell-surface protein or receptor or receptor subunit.

Methods for making bispecific antibodies are known in the art. Traditionally, the recombinant production of bispecific antibodies is based on the co-expression of two immunoglobulin heavy-chain/light-chain pairs, where the two heavy chains have different specificities (Milstein and Cuello, *Nature*, 305:537–539 (1983)). Because of the random assortment of immunoglobulin heavy and light chains, these hybridomas (quadromas) produce a potential mixture of ten different antibody molecules, of which only one has the correct bispecific structure. The purification of the correct molecule is usually accomplished by affinity chromatography steps. Similar procedures are disclosed in WO 93/08829, published 13 May 1993, and in Traunecker et al., 1991 *EMBO J.*, 10:3655–3659.

Antibody variable domains with the desired binding specificities (antibody-antigen combining sites) can be fused to immunoglobulin constant domain sequences. The fusion preferably is with an immunoglobulin heavy-chain constant domain, comprising at least part of the hinge, CH2, and CH3 regions. It is preferred to have the first heavy-chain constant region (CH1) containing the site necessary for light-chain binding present in at least one of the fusions. DNAs encoding the immunoglobulin heavy-chain fusions and, if desired, the immunoglobulin light chain, are inserted into separate expression vectors, and are co-transfected into a suitable host organism. For further details of generating bispecific antibodies see, for example, Suresh et al., *Methods in Enzymology*, 121:210 (1986).

According to another approach described in WO 96/27011, the interface between a pair of antibody molecules can be engineered to maximize the percentage of heterodimers which are recovered from recombinant cell culture. The preferred interface comprises at least a part of the CH3 region of an antibody constant domain. In this method, one or more small amino acid side chains from the interface of the first antibody molecule are replaced with larger side chains (e.g. tyrosine or tryptophan). Compensatory "cavities" of identical or similar size to the large side chain(s) are created on the interface of the second antibody molecule by replacing large amino acid side chains with smaller ones (e.g. alanine or threonine). This provides a mechanism for increasing the yield of the heterodimer over other unwanted end-products such as homodimers.

Bispecific antibodies can be prepared as full length antibodies or antibody fragments (e.g. F(ab')$_2$ bispecific antibodies). Techniques for generating bispecific antibodies from antibody fragments have been described in the literature. For example, bispecific antibodies can be prepared using chemical linkage. Brennan et al., *Science* 229:81 (1985) describe a procedure wherein intact antibodies are proteolytically cleaved to generate F(ab')$_2$ fragments. These fragments are reduced in the presence of the dithiol com26S protease regulatory subunit 4 g agent sodium arsenite to stabilize vicinal dithiols and prevent intermolecular disulfide formation. The Fab' fragments generated are then converted to thionitrobenzoate (TNB) derivatives. One of the Fab'-TNB derivatives is then reconverted to the Fab'-thiol by reduction with mercaptoethylamine and is mixed with an equimolar amount of the other Fab'-TNB derivative to form the bispecific antibody. The bispecific antibodies produced can be used as agents for the selective immobilization of enzymes.

Additionally, Fab' fragments can be directly recovered from *E. coli* and chemically coupled to form bispecific antibodies. Shalaby et al., *J. Exp. Med.* 175:217–225 (1992) describe the production of a fully humanized bispecific antibody F(ab')$_2$ molecule. Each Fab' fragment was separately secreted from *E. coli* and subjected to directed chemical coupling in vitro to form the bispecific antibody. The bispecific antibody thus formed was able to bind to cells overexpressing the ErbB2 receptor and normal human T cells, as well as trigger the lytic activity of human cytotoxic lymphocytes against human breast tumor targets.

Various techniques for making and isolating bispecific antibody fragments directly from recombinant cell culture have also been described. For example, bispecific antibodies have been produced using leucine zippers. Kostelny et al., *J. Immunol.* 148(5):1547–1553 (1992). The leucine zipper peptides from the Fos and Jun proteins were linked to the Fab' portions of two different antibodies by gene fusion. The antibody homodimers were reduced at the hinge region to form monomers and then re-oxidized to form the antibody heterodimers. This method can also be utilized for the production of antibody homodimers. The "diabody" technology described by Hollinger et al., *Proc. Natl. Acad. Sci. USA* 90:6444–6448 (1993) has provided an alternative mechanism for making bispecific antibody fragments. The fragments comprise a heavy-chain variable domain ($V_H$) connected to a light-chain variable domain ($V_L$) by a linker which is too short to allow pairing between the two domains on the same chain. Accordingly, the $V_H$ and $V_L$ domains of one fragment are forced to pair with the complementary $V_L$ and $V_H$ domains of another fragment, thereby forming two antigen-binding sites. Another strategy for making bispecific antibody fragments by the use of single-chain Fv (sFv) dimers has also been reported. See, Gruber et al., *J. Immunol.* 152:5368 (1994).

Antibodies with more than two valencies are contemplated. For example, trispecific antibodies can be prepared. Tutt et al., *J. Immunol.* 147:60 (1991).

Exemplary bispecific antibodies can bind to two different epitopes, at least one of which originates in the protein antigen of the invention. Alternatively, an anti-antigenic arm of an immunoglobulin molecule can be combined with an arm which binds to a triggering molecule on a leukocyte such as a T-cell receptor molecule (e.g. CD2, CD3, CD28, or B7), or Fc receptors for IgG (FcγR), such as FcγRI (CD64), FcγRII (CD32) and FcγRIII (CD16) so as to focus cellular defense mechanisms to the cell expressing the particular antigen. Bispecific antibodies can also be used to direct cytotoxic agents to cells which express a particular antigen. These antibodies possess an antigen-binding arm and an arm which binds a cytotoxic agent or a radionuclide chelator, such as EOTUBE, DPTA, DOTA, or TETA. Another bispecific antibody of interest binds the protein antigen described herein and further binds tissue factor (TF).

Heteroconjugate Antibodies

Heteroconjugate antibodies are also within the scope of the present invention. Heteroconjugate antibodies are composed of two covalently joined antibodies. Such antibodies have, for example, been proposed to target immune system cells to unwanted cells (U.S. Pat. No. 4,676,980), and for treatment of HIV infection (WO 91/00360; WO 92/200373; EP 03089). It is contemplated that the antibodies can be prepared in vitro using known methods in synthetic protein chemistry, including those involving crosslinking agents. For example, immunotoxins can be constructed using a disulfide exchange reaction or by forming a thioether bond. Examples of suitable reagents for this purpose include iminothiolate and methyl-4-mercaptobutyrimidate and those disclosed, for example, in U.S. Pat. No. 4,676,980.

Effector Function Engineering

It can be desirable to modify the antibody of the invention with respect to effector function, so as to enhance, e.g., the effectiveness of the antibody in treating cancer. For example, cysteine residue(s) can be introduced into the Fc region, thereby allowing interchain disulfide bond formation in this region. The homodimeric antibody thus generated can have improved internalization capability and/or increased complement-mediated cell killing and antibody-dependent cellular cytotoxicity (ADCC). See Caron et al., J. Exp Med., 176: 1191–1195 (1992) and Shopes, J. Immunol., 148: 2918–2922 (1992). Homodimeric antibodies with enhanced anti-tumor activity can also be prepared using heterobifunctional cross-linkers as described in Wolff et al. Cancer Research, 53: 2560–2565 (1993). Alternatively, an antibody can be engineered that has dual Fc regions and can thereby have enhanced complement lysis and ADCC capabilities. See Stevenson et al., Anti-Cancer Drug Design, 3: 219–230 (1989).

Immunoconjugates

The invention also pertains to immunoconjugates comprising an antibody conjugated to a cytotoxic agent such as a chemotherapeutic agent, toxin (e.g., an enzymatically active toxin of bacterial, fungal, plant, or animal origin, or fragments thereof), or a radioactive isotope (i.e., a radioconjugate).

Chemotherapeutic agents useful in the generation of such immunoconjugates have been described above. Enzymatically active toxins and fragments thereof that can be used include diphtheria A chain, nonbinding active fragments of diphtheria toxin, exotoxin A chain (from Pseudomonas aeruginosa), ricin A chain, abrin A chain, modeccin A chain, alpha-sarcin, Aleurites fordii proteins, dianthin proteins, Phytolaca americana proteins (PAPI, PAPII, and PAP-S), momordica charantia inhibitor, curcin, crotin, sapaonaria officinalis inhibitor, gelonin, mitogellin, restrictocin, phenomycin, enomycin, and the tricothecenes. A variety of radionuclides are available for the production of radioconjugated antibodies. Examples include $^{212}$Bi, $^{131}$I, $^{131}$In, $^{90}$Y, and $^{186}$Re.

Conjugates of the antibody and cytotoxic agent are made using a variety of bifunctional protein-coupling agents such as N-succinimidyl-3-(2-pyridyldithiol)propionate (SPDP), iminothiolane (IT), bifunctional derivatives of imidoesters (such as dimethyl adipimidate HCL), active esters (such as disuccinimidyl suberate), aldehydes (such as glutareldehyde), bis-azido compounds (such as bis (p-azidobenzoyl)hexanediamine), bis-diazonium derivatives (such as bis-(p-diazoniumbenzoyl)-ethylenediamine), diisocyanates (such as tolyene 2,6-diisocyanate), and bis-active fluorine compounds (such as 1,5-difluoro-2,4-dinitrobenzene). For example, a ricin immunotoxin can be prepared as described in Vitetta et al., Science, 238: 1098 (1987). Carbon-14-labeled 1-isothiocyanatobenzyl-3-methyldiethylene triaminepentaacetic acid (MX-DTPA) is an exemplary chelating agent for conjugation of radionucleotide to the antibody. See WO94/11026.

In another embodiment, the antibody can be conjugated to a "receptor" (such streptavidin) for utilization in tumor pretargeting wherein the antibody-receptor conjugate is administered to the patient, followed by removal of unbound conjugate from the circulation using a clearing agent and then administration of a "ligand" (e.g., avidin) that is in turn conjugated to a cytotoxic agent.

In one embodiment, methods for the screening of antibodies that possess the desired specificity include, but are not limited to, enzyme-linked immunosorbent assay (ELISA) and other immunologically-mediated techniques known within the art. In a specific embodiment, selection of antibodies that are specific to a particular domain of an NOVX protein is facilitated by generation of hybridomas that bind to the fragment of an NOVX protein possessing such a domain. Thus, antibodies that are specific for a desired domain within an NOVX protein, or derivatives, fragments, analogs or homologs thereof, are also provided herein.

Anti-NOVX antibodies may be used in methods known within the art relating to the localization and/or quantitation of an NOVX protein (e.g., for use in measuring levels of the NOVX protein within appropriate physiological samples, for use in diagnostic methods, for use in imaging the protein, and the like). In a given embodiment, antibodies for NOVX proteins, or derivatives, fragments, analogs or homologs thereof, that contain the antibody derived binding domain, are utilized as pharmacologically-active compounds (hereinafter "Therapeutics").

An anti-NOVX antibody (e.g., monoclonal antibody) can be used to isolate an NOVX polypeptide by standard techniques, such as affinity chromatography or immunoprecipitation. An anti-NOVX antibody can facilitate the purification of natural NOVX polypeptide from cells and of recombinantly-produced NOVX polypeptide expressed in host cells. Moreover, an anti-NOVX antibody can be used to detect NOVX protein (e.g., in a cellular lysate or cell supernatant) in order to evaluate the abundance and pattern of expression of the NOVX protein. Anti-NOVX antibodies can be used diagnostically to monitor protein levels in tissue as part of a clinical testing procedure, e.g., to, for example, determine the efficacy of a given treatment regimen. Detection can be facilitated by coupling (i.e., physically linking) the antibody to a detectable substance. Examples of detectable substances include various enzymes, prosthetic groups, fluorescent materials, luminescent materials, bioluminescent materials, and radioactive materials. Examples of suitable enzymes include horseradish peroxidase, alkaline phosphatase, β-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and aequorin, and examples of suitable radioactive material include $^{125}I$, $^{131}I$, $^{35}S$ or $^3H$.

NOVX Recombinant Expression Vectors and Host Cells

Another aspect of the invention pertains to vectors, preferably expression vectors, containing a nucleic acid encoding an NOVX protein, or derivatives, fragments, analogs or homologs thereof. As used herein, the term "vector" refers to a nucleic acid molecule capable of transporting another nucleic acid to which it has been linked. One type of vector is a "plasmid", which refers to a circular double stranded DNA loop into which additional DNA segments can be ligated. Another type of vector is a viral vector, wherein additional DNA segments can be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively-linked. Such vectors are referred to herein as "expression vectors". In general, expression vectors of utility in recombinant DNA techniques are often in the form of plasmids. In the present specification, "plasmid" and "vector" can be used interchangeably as the plasmid is the most commonly used form of vector. However, the invention is intended to include such other forms of expression vectors, such as viral vectors (e.g., replication defective retroviruses, adenoviruses and adeno-associated viruses), which serve equivalent functions.

The recombinant expression vectors of the invention comprise a nucleic acid of the invention in a form suitable for expression of the nucleic acid in a host cell, which means that the recombinant expression vectors include one or more regulatory sequences, selected on the basis of the host cells to be used for expression, that is operatively-linked to the nucleic acid sequence to be expressed. Within a recombinant expression vector, "operably-linked" is intended to mean that the nucleotide sequence of interest is linked to the regulatory sequence(s) in a manner that allows for expression of the nucleotide sequence (e.g., in an in vitro transcription/translation system or in a host cell when the vector is introduced into the host cell).

The term "regulatory sequence" is intended to includes promoters, enhancers and other expression control elements (e.g., polyadenylation signals). Such regulatory sequences are described, for example, in Goeddel, GENE EXPRESSION TECHNOLOGY: METHODS IN ENZYMOLOGY 185, Academic Press, San Diego, Calif. (1990). Regulatory sequences include those that direct constitutive expression of a nucleotide sequence in many types of host cell and those that direct expression of the nucleotide sequence only in certain host cells (e.g., tissue-specific regulatory sequences). It will be appreciated by those skilled in the art that the design of the expression vector can depend on such factors as the choice of the host cell to be transformed, the level of expression of protein desired, etc. The expression vectors of the invention can be introduced into host cells to thereby produce proteins or peptides, including fusion proteins or peptides, encoded by nucleic acids as described herein (e.g., NOVX proteins, mutant forms of NOVX proteins, fusion proteins, etc.).

The recombinant expression vectors of the invention can be designed for expression of NOVX proteins in prokaryotic or eukaryotic cells. For example, NOVX proteins can be expressed in bacterial cells such as Escherichia coli, insect cells (using baculovirus expression vectors) yeast cells or mammalian cells. Suitable host cells are discussed further in Goeddel, GENE EXPRESSION TECHNOLOGY: METHODS IN ENZYMOLOGY 185, Academic Press, San Diego, Calif. (1990). Alternatively, the recombinant expression vector can be transcribed and translated in vitro, for example using T7 promoter regulatory sequences and T7 polymerase.

Expression of proteins in prokaryotes is most often carried out in *Escherichia coli* with vectors containing constitutive or inducible promoters directing the expression of either fusion or non-fusion proteins. Fusion vectors add a number of amino acids to a protein encoded therein, usually to the amino terminus of the recombinant protein. Such fusion vectors typically serve three purposes: (i) to increase expression of recombinant protein; (ii) to increase the solubility of the recombinant protein; and (iii) to aid in the purification of the recombinant protein by acting as a ligand in affinity purification. Often, in fusion expression vectors, a proteolytic cleavage site is introduced at the junction of the fusion moiety and the recombinant protein to enable separation of the recombinant protein from the fusion moiety subsequent to purification of the fusion protein. Such enzymes, and their cognate recognition sequences, include Factor Xa, thrombin and enterokinase. Typical fusion expression vectors include pGEX (Pharmacia Biotech Inc; Smith and Johnson, 1988. *Gene* 67: 31–40), pMAL (New England Biolabs, Beverly, Mass.) and pRIT5 (Pharmacia, Piscataway, N.J.) that fuse glutathione S-transferase (GST), maltose E binding protein, or protein A, respectively, to the target recombinant protein.

Examples of suitable inducible non-fusion *E. coli* expression vectors include pTrc (Amrann et al., (1988) *Gene* 69:301–315) and pET 11d (Studier et al., GENE EXPRESSION TECHNOLOGY: METHODS IN ENZYMOLOGY 185, Academic Press, San Diego, Calif. (1990) 60–89).

One strategy to maximize recombinant protein expression in *E. coli* is to express the protein in a host bacteria with an impaired capacity to proteolytically cleave the recombinant protein. See, e.g., Gottesman, GENE EXPRESSION TECHNOLOGY: METHODS IN ENZYMOLOGY 185, Academic Press, San Diego, Calif. (1990) 119–128. Another strategy is to alter the nucleic acid sequence of the nucleic acid to be inserted into an expression vector so that the individual codons for each amino acid are those preferentially utilized in *E. coli* (see, e.g., Wada, et al., 1992. *Nucl. Acids Res.* 20: 2111–2118). Such alteration of nucleic acid sequences of the invention can be carried out by standard DNA synthesis techniques.

In another embodiment, the NOVX expression vector is a yeast expression vector. Examples of vectors for expression in yeast *Saccharonzyces cerivisae* include pYepSec1 (Baldari, et al., 1987. *EMBO J.* 6: 229–234), pMFa (Kurjan and Herskowitz, 1982. *Cell* 30: 933–943), pJRY88 (Schultz et al., 1987. *Gene* 54: 113–123), pYES2 (Invitrogen Corporation, San Diego, Calif.), and picZ (InVitrogen Corp, San Diego, Calif.).

Alternatively, NOVX can be expressed in insect cells using baculovirus expression vectors. Baculovirus vectors available for expression of proteins in cultured insect cells (e.g., SF9 cells) include the pAc series (Smith, et al., 1983. *Mol. Cell. Biol.* 3: 2156–2165) and the pVL series (Lucklow and Summers, 1989. *Virology* 170: 31–39).

In yet another embodiment, a nucleic acid of the invention is expressed in mammalian cells using a mammalian expression vector. Examples of mammalian expression vectors include pCDM8 (Seed, 1987. *Nature* 329: 840) and pMT2PC (Kaufman, et al., 1987. *EMBO J.* 6: 187–195). When used in mammalian cells, the expression vector's control functions are often provided by viral regulatory elements. For example, commonly used promoters are derived from polyoma, adenovirus 2, cytomegalovirus, and simian virus 40. For other suitable expression systems for both prokaryotic and eukaryotic cells see, e.g., Chapters 16 and 17 of Sambrook, et al., MOLECULAR CLONING: A LABORATORY MANUAL. 2nd ed., Cold Spring Harbor Laboratory, Cold Spring Harbor Laboratory Press, Cold Spring Harbor, N.Y., 1989.

In another embodiment, the recombinant mammalian expression vector is capable of directing expression of the nucleic acid preferentially in a particular cell type (e.g., tissue-specific regulatory elements are used to express the nucleic acid). Tissue-specific regulatory elements are known in the art. Non-limiting examples of suitable tissue-specific promoters include the albumin promoter (liver-specific; Pinkert, et al., 1987. *Genes Dev.* 1: 268–277), lymphoid-specific promoters (Calame and Eaton, 1988. *Adv. Immunol.* 43: 235–275), in particular promoters of T cell receptors (Winoto and Baltimore, 1989. *EMBO J.* 8: 729–733) and immunoglobulins (Banedji, et al., 1983. *Cell* 33: 729–740; Queen and Baltimore, 1983. *Cell* 33: 741–748), neuron-specific promoters (e.g., the neurofilament promoter; Byrne and Ruddle, 1989. *Proc. Natl. Acad. Sci. USA* 86: 5473–5477), pancreas-specific promoters (Edlund, et al., 1985. *Science* 230: 912–916), and mammary gland-specific promoters (e.g., milk whey promoter; U.S. Pat. No. 4,873,316 and European Application Publication No. 264,166). Developmentally-regulated promoters are also encompassed, e.g., the murine hox promoters (Kessel and Gruss, 1990. *Science* 249: 374–379) and the α-fetoprotein promoter (Campes and Tilghman, 1989. *Genes Dev.* 3: 537–546).

The invention further provides a recombinant expression vector comprising a DNA molecule of the invention cloned into the expression vector in an antisense orientation. That is, the DNA molecule is operatively-linked to a regulatory sequence in a manner that allows for expression (by transcription of the DNA molecule) of an RNA molecule that is antisense to NOVX mRNA. Regulatory sequences operatively linked to a nucleic acid cloned in the antisense orientation can be chosen that direct the continuous expression of the antisense RNA molecule in a variety of cell types, for instance viral promoters and/or enhancers, or regulatory sequences can be chosen that direct constitutive, tissue specific or cell type specific expression of antisense RNA. The antisense expression vector can be in the form of a recombinant plasmid, phagemid or attenuated virus in which antisense nucleic acids are produced under the control of a high efficiency regulatory region, the activity of which can be determined by the cell type into which the vector is introduced. For a discussion of the regulation of gene expression using antisense genes see, e.g., Weintraub, et al., "Antisense RNA as a molecular tool for genetic analysis," *Reviews-Trends in Genetics*, Vol. 1(1) 1986.

Another aspect of the invention pertains to host cells into which a recombinant expression vector of the invention has been introduced. The terms "host cell" and "recombinant host cell" are used interchangeably herein. It is understood that such terms refer not only to the particular subject cell but also to the progeny or potential progeny of such a cell. Because certain modifications may occur in succeeding generations due to either mutation or environmental influences, such progeny may not, in fact, be identical to the parent cell, but are still included within the scope of the term as used herein.

A host cell can be any prokaryotic or eukaryotic cell. For example, NOVX protein can be expressed in bacterial cells such as *E. coli*, insect cells, yeast or mammalian cells (such as Chinese hamster ovary cells (CHO) or COS cells). Other suitable host cells are known to those skilled in the art.

Vector DNA can be introduced into prokaryotic or eukaryotic cells via conventional transformation or transfection techniques. As used herein, the terms "transformation" and "transfection" are intended to refer to a variety of art-recognized techniques for introducing foreign nucleic acid (e.g., DNA) into a host cell, including calcium phosphate or calcium chloride co-precipitation, DEAE-dextran-mediated transfection, lipofection, or electroporation. Suitable methods for transforming or transfecting host cells can be found in Sambrook, et al. (MOLECULAR CLONING: A LABORATORY MANUAL. 2nd ed., Cold Spring Harbor Laboratory, Cold Spring Harbor Laboratory Press, Cold Spring Harbor, N.Y., 1989), and other laboratory manuals.

For stable transfection of mammalian cells, it is known that, depending upon the expression vector and transfection technique used, only a small fraction of cells may integrate the foreign DNA into their genome. In order to identify and select these integrants, a gene that encodes a selectable marker (e.g., resistance to antibiotics) is generally introduced into the host cells along with the gene of interest. Various selectable markers include those that confer resistance to drugs, such as G418, hygromycin and methotrexate. Nucleic acid encoding a selectable marker can be introduced into a host cell on the same vector as that encoding NOVX or can be introduced on a separate vector. Cells stably transfected with the introduced nucleic acid can be identified by drug selection (e.g., cells that have incorporated the selectable marker gene will survive, while the other cells die).

A host cell of the invention, such as a prokaryotic or eukaryotic host cell in culture, can be used to produce (i.e., express) NOVX protein. Accordingly, the invention further provides methods for producing NOVX protein using the host cells of the invention. In one embodiment, the method comprises culturing the host cell of invention (into which a recombinant expression vector encoding NOVX protein has been introduced) in a suitable medium such that NOVX protein is produced. In another embodiment, the method further comprises isolating NOVX protein from the medium or the host cell.

Transgenic NOVX Animals

The host cells of the invention can also be used to produce non-human transgenic animals. For example, in one embodiment, a host cell of the invention is a fertilized oocyte or an embryonic stem cell into which NOVX protein-coding sequences have been introduced. Such host cells can then be used to create non-human transgenic animals in which exogenous NOVX sequences have been introduced into their genome or homologous recombinant animals in which endogenous NOVX sequences have been altered. Such animals are useful for studying the function and/or activity of NOVX protein and for identifying and/or evaluating modulators of NOVX protein activity. As used herein, a "transgenic animal" is a non-human animal, preferably a mammal, more preferably a rodent such as a rat or mouse, in which one or more of the cells of the animal includes a transgene. Other examples of transgenic animals include non-human primates, sheep, dogs, cows, goats, chickens, amphibians, etc. A transgene is exogenous DNA that is integrated into the genome of a cell from which a transgenic animal develops and that remains in the genome of the mature animal, thereby directing the expression of an encoded gene product in one or more cell types or tissues of the transgenic animal. As used herein, a "homologous recombinant animal" is a non-human animal, preferably a mammal, more preferably a mouse, in which an endogenous NOVX gene has been altered by homologous recombination between the endogenous gene and an exogenous DNA molecule introduced into a cell of the animal, e.g., an embryonic cell of the animal, prior to development of the animal.

A transgenic animal of the invention can be created by introducing NOVX-encoding nucleic acid into the male pronuclei of a fertilized oocyte (e.g., by microinjection, retroviral infection) and allowing the oocyte to develop in a pseudopregnant female foster animal. The human NOVX cDNA sequences SEQ ID NOS:1, 3, 5, 7, 9, 11, 13, 15, 17, 19, 21, 23, 25, 27, 29, 31, and 217 can be introduced as a transgene into the genome of a non-human animal. Alternatively, a non-human homologue of the human NOVX gene, such as a mouse NOVX gene, can be isolated based on hybridization to the human NOVX cDNA (described further supra) and used as a transgene. Intronic sequences and polyadenylation signals can also be included in the transgene to increase the efficiency of expression of the transgene. A tissue-specific regulatory sequence(s) can be operably-linked to the NOVX transgene to direct expression of NOVX protein to particular cells. Methods for generating transgenic animals via embryo manipulation and microinjection, particularly animals such as mice, have become conventional in the art and are described, for example, in U.S. Pat. Nos. 4,736,866; 4,870,009; and 4,873,191; and Hogan, 1986. In: MANIPULATING THE MOUSE EMBRYO, Cold Spring Harbor Laboratory Press, Cold Spring Harbor, N.Y. Similar methods are used for production of other transgenic animals. A transgenic founder animal can be identified based upon the presence of the NOVX transgene in its genome and/or expression of NOVX mRNA in tissues or cells of the animals. A transgenic founder animal can then be used to breed additional animals carrying the transgene. Moreover, transgenic animals carrying a transgene-encoding NOVX protein can further be bred to other transgenic animals carrying other transgenes.

To create a homologous recombinant animal, a vector is prepared which contains at least a portion of an NOVX gene into which a deletion, addition or substitution has been introduced to thereby alter, e.g., functionally disrupt, the NOVX gene. The NOVX gene can be a human gene (e.g., the cDNA of SEQ ID NOS:1, 3, 5, 7, 9, 11, 13, 15, 17, 19, 21, 23, 25, 27, 29, 31, and 217), but more preferably, is a non-human homologue of a human NOVX gene. For example, a mouse homologue of human NOVX gene of SEQ ID NOS:1, 3, 5, 7, 9, 11, 13, 15, 17, 19, 21, 23, 25, 27, 29, 31, and 217 can be used to construct a homologous recombination vector suitable for altering an endogenous NOVX gene in the mouse genome. In one embodiment, the vector is designed such that, upon homologous recombination, the endogenous NOVX gene is functionally disrupted (i.e., no longer encodes a functional protein; also referred to as a "knock out" vector).

Alternatively, the vector can be designed such that, upon homologous recombination, the endogenous NOVX gene is mutated or otherwise altered but still encodes functional protein (e.g., the upstream regulatory region can be altered to thereby alter the expression of the endogenous NOVX protein). In the homologous recombination vector, the altered portion of the NOVX gene is flanked at its 5'- and 3'-termini by additional nucleic acid of the NOVX gene to allow for homologous recombination to occur between the exogenous NOVX gene carried by the vector and an endogenous NOVX gene in an embryonic stem cell. The additional flanking NOVX nucleic acid is of sufficient length for successful homologous recombination with the endogenous gene. Typically, several kilobases of flanking DNA (both at the 5'- and 3'-termini) are included in the vector. See, e.g., Thomas, et al., 1987. *Cell* 51: 503 for a description of homologous recombination vectors. The vector is then introduced into an embryonic stem cell line (e.g., by electroporation) and cells in which the introduced NOVX gene has homologously-recombined with the endogenous NOVX gene are selected. See, e.g., Li, et al., 1992. *Cell* 69: 915.

The selected cells are then injected into a blastocyst of an animal (e.g., a mouse) to form aggregation chimeras. See, e.g., Bradley, 1987. In: TERATOCARCINOMAS AND EMBRYONIC STEM CELLS: A PRACTICAL APPROACH, Robertson, ed. IRL, Oxford, pp. 113–152. A chimeric embryo can then be implanted into a suitable pseudopregnant female foster animal and the embryo brought to term. Progeny harboring the homologously-recombined DNA in their germ cells can be used to breed animals in which all cells of the animal contain the homologously-recombined DNA by germline transmission of the transgene. Methods for constructing homologous recombination vectors and homologous recombinant animals are described further in Bradley, 1991. *Curr. Opin. Biotechnol.* 2: 823–829; PCT International Publication Nos.: WO 90/11354; WO 91/01140; WO 92/0968; and WO 93/04169.

In another embodiment, transgenic non-humans animals can be produced that contain selected systems that allow for regulated expression of the transgene. One example of such a system is the cre/loxP recombinase system of bacteriophage P1. For a description of the cre/loxP recombinase system, See, e.g., Lakso, et al., 1992. *Proc. Natl. Acad. Sci. USA* 89: 6232–6236. Another example of a recombinase system is the FLP recombinase system of *Saccharomyces cerevisiae*. See, O'Gorman, et al., 1991. *Science* 251:1351–1355. If a cre/loxP recombinase system is used to regulate expression of the transgene, animals containing transgenes encoding both the Cre recombinase and a selected protein are required. Such animals can be provided through the construction of "double" transgenic animals, e.g., by mating two transgenic animals, one containing a transgene encoding a selected protein and the other containing a transgene encoding a recombinase.

Clones of the non-human transgenic animals described herein can also be produced according to the methods described in Wilmut, et al., 1997. *Nature* 385: 810–813. In brief, a cell (e.g., a somatic cell) from the transgenic animal can be isolated and induced to exit the growth cycle and enter $G_0$ phase. The quiescent cell can then be fused, e.g., through the use of electrical pulses, to an enucleated oocyte from an animal of the same species from which the quiescent cell is isolated. The reconstructed oocyte is then cultured such that it develops to morula or blastocyte and then transferred to pseudopregnant female foster animal. The offspring borne of this female foster animal will be a clone of the animal from which the cell (e.g., the somatic cell) is isolated.

Pharmaceutical Compositions

The NOVX nucleic acid molecules, NOVX proteins, and anti-NOVX antibodies (also referred to herein as "active compounds") of the invention, and derivatives, fragments, analogs and homologs thereof, can be incorporated into pharmaceutical compositions suitable for administration. Such compositions typically comprise the nucleic acid molecule, protein, or antibody and a pharmaceutically acceptable carrier. As used herein, "pharmaceutically acceptable carrier" is intended to include any and all solvents, dispersion media, coatings, antibacterial and antifungal agents, isotonic and absorption delaying agents, and the like, compatible with pharmaceutical administration. Suitable carriers are described in the most recent edition of Remington's Pharmaceutical Sciences, a standard reference text in the field, which is incorporated herein by reference. Preferred examples of such carriers or diluents include, but are not limited to, water, saline, finger's solutions, dextrose solution, and 5% human serum albumin. Liposomes and non-aqueous vehicles such as fixed oils may also be used. The use of such media and agents for pharmaceutically active substances is well known in the art. Except insofar as any conventional media or agent is incompatible with the active compound, use thereof in the compositions is contemplated. Supplementary active compounds can also be incorporated into the compositions.

A pharmaceutical composition of the invention is formulated to be compatible with its intended route of administration. Examples of routes of administration include parenteral, e.g., intravenous, intradermal, subcutaneous, oral (e.g., inhalation), transdermal (i.e., topical), transmucosal, and rectal administration. Solutions or suspensions used for parenteral, intradermal, or subcutaneous application can include the following components: a sterile diluent such as water for injection, saline solution, fixed oils, polyethylene glycols, glycerine, propylene glycol or other synthetic solvents; antibacterial agents such as benzyl alcohol or methyl parabens; antioxidants such as ascorbic acid or sodium bisulfite; chelating agents such as ethylenediaminetetraacetic acid (EDTA); buffers such as acetates, citrates or phosphates, and agents for the adjustment of tonicity such as sodium chloride or dextrose. The pH can be adjusted with acids or bases, such as hydrochloric acid or sodium hydroxide. The parenteral preparation can be enclosed in ampoules, disposable syringes or multiple dose vials made of glass or plastic.

Pharmaceutical compositions suitable for injectable use include sterile aqueous solutions (where water soluble) or dispersions and sterile powders for the extemporaneous preparation of sterile injectable solutions or dispersion. For intravenous administration, suitable carriers include physiological saline, bacteriostatic water, Cremophor EL™ (BASF, Parsippany, N.J.) or phosphate buffered saline (PBS). In all cases, the composition must be sterile and should be fluid to the extent that easy syringeability exists. It must be stable under the conditions of manufacture and storage and must be preserved against the contaminating action of microorganisms such as bacteria and fungi. The carrier can be a solvent or dispersion medium containing, for example, water, ethanol, polyol (for example, glycerol, propylene glycol, and liquid polyethylene glycol, and the like), and suitable mixtures thereof. The proper fluidity can be maintained, for example, by the use of a coating such as lecithin, by the maintenance of the required particle size in the case of dispersion and by the use of surfactants. Prevention of the action of microorganisms can be achieved by various antibacterial and antifungal agents, for example, parabens, chlorobutanol, phenol, ascorbic acid, thimerosal, and the like. In many cases, it will be preferable to include isotonic agents, for example, sugars, polyalcohols such as manitol, sorbitol, sodium chloride in the composition. Prolonged absorption of the injectable compositions can be brought about by including in the composition an agent which delays absorption, for example, aluminum monostearate and gelatin.

Sterile injectable solutions can be prepared by incorporating the active compound (e.g., an NOVX protein or anti-NOVX antibody) in the required amount in an appropriate solvent with one or a combination of ingredients enumerated above, as required, followed by filtered sterilization. Generally, dispersions are prepared by incorporating the active compound into a sterile vehicle that contains a basic dispersion medium and the required other ingredients from those enumerated above. In the case of sterile powders for the preparation of sterile injectable solutions, methods of preparation are vacuum drying and freeze-drying that yields a powder of the active ingredient plus any additional desired ingredient from a previously sterile-filtered solution thereof.

Oral compositions generally include an inert diluent or an edible carrier. They can be enclosed in gelatin capsules or compressed into tablets. For the purpose of oral therapeutic administration, the active compound can be incorporated with excipients and used in the form of tablets, troches, or capsules. Oral compositions can also be prepared using a fluid carrier for use as a mouthwash, wherein the compound in the fluid carrier is applied orally and swished and expectorated or swallowed. Pharmaceutically compatible binding agents, and/or adjuvant materials can be included as part of the composition. The tablets, pills, capsules, troches and the like can contain any of the following ingredients, or compounds of a similar nature: a binder such as microcrystalline cellulose, gum tragacanth or gelatin; an excipient such as starch or lactose, a disintegrating agent such as alginic acid, Primogel, or corn starch; a lubricant such as magnesium stearate or Sterotes; a glidant such as colloidal silicon dioxide; a sweetening agent such as sucrose or saccharin; or a flavoring agent such as peppermint, methyl salicylate, or orange flavoring.

For administration by inhalation, the compounds are delivered in the form of an aerosol spray from pressured container or dispenser which contains a suitable propellant, e.g., a gas such as carbon dioxide, or a nebulizer.

Systemic administration can also be by transmucosal or transdermal means. For transmucosal or transdermal administration, penetrants appropriate to the barrier to be permeated are used in the formulation. Such penetrants are generally known in the art, and include, for example, for transmucosal administration, detergents, bile salts, and fusidic acid derivatives. Transmucosal administration can be accomplished through the use of nasal sprays or suppositories. For transdermal administration, the active compounds are formulated into ointments, salves, gels, or creams as generally known in the art.

The compounds can also be prepared in the form of suppositories (e.g., with conventional suppository bases such as cocoa butter and other glycerides) or retention enemas for rectal delivery.

In one embodiment, the active compounds are prepared with carriers that will protect the compound against rapid elimination from the body, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, and polylactic acid. Methods for preparation of such formulations will be apparent to those skilled in the art. The materials can also be obtained commercially from Alza Corporation and Nova Pharmaceuticals, Inc. Liposomal suspensions (including liposomes targeted to infected cells with monoclonal antibodies to viral antigens) can also be used as pharmaceutically acceptable carriers. These can be prepared according to methods known to those skilled in the art, for example, as described in U.S. Pat. No. 4,522,811.

It is especially advantageous to formulate oral or parenteral compositions in dosage unit form for ease of administration and uniformity of dosage. Dosage unit form as used herein refers to physically discrete units suited as unitary dosages for the subject to be treated; each unit containing a predetermined quantity of active compound calculated to produce the desired therapeutic effect in association with the required pharmaceutical carrier. The specification for the dosage unit forms of the invention are dictated by and directly dependent on the unique characteristics of the active compound and the particular therapeutic effect to be achieved, and the limitations inherent in the art of compounding such an active compound for the treatment of individuals.

The nucleic acid molecules of the invention can be inserted into vectors and used as gene therapy vectors. Gene therapy vectors can be delivered to a subject by, for example, intravenous injection, local administration (see, e.g., U.S. Pat. No. 5,328,470) or by stereotactic injection (see, e.g., Chen, et al., 1994. *Proc. Natl. Acad. Sci. USA* 91: 3054–3057). The pharmaceutical preparation of the gene therapy vector can include the gene therapy vector in an acceptable diluent, or can comprise a slow release matrix in which the gene delivery vehicle is imbedded. Alternatively, where the complete gene delivery vector can be produced intact from recombinant cells, e.g., retroviral vectors, the pharmaceutical preparation can include one or more cells that produce the gene delivery system.

The pharmaceutical compositions can be included in a container, pack, or dispenser together with instructions for administration.

Screening and Detection Methods

The isolated nucleic acid molecules of the invention can be used to express NOVX protein (e.g., via a recombinant expression vector in a host cell in gene therapy applications), to detect NOVX mRNA (e.g., in a biological sample) or a genetic lesion in an NOVX gene, and to modulate NOVX activity, as described further, below. In addition, the NOVX proteins can be used to screen drugs or compounds that modulate the NOVX protein activity or expression as well as to treat disorders characterized by insufficient or excessive production of NOVX protein or production of NOVX protein forms that have decreased or aberrant activity compared to NOVX wild-type protein (e.g.; diabetes (regulates insulin release); obesity (binds and transport lipids); metabolic disturbances associated with obesity, the metabolic syndrome X as well as anorexia and wasting disorders associated with chronic diseases and various cancers, and infectious disease(possesses anti-microbial activity) and the various dyslipidemias. In addition, the anti-NOVX antibodies of the invention can be used to detect and isolate NOVX proteins and modulate NOVX activity. In yet a further aspect, the invention can be used in methods to influence appetite, absorption of nutrients and the disposition of metabolic substrates in both a positive and negative fashion.

The invention further pertains to novel agents identified by the screening assays described herein and uses thereof for treatments as described, supra.

Screening Assays

The invention provides a method (also referred to herein as a "screening assay") for identifying modulators, i.e., candidate or test compounds or agents (e.g., peptides, peptidomimetics, small molecules or other drugs) that bind to NOVX proteins or have a stimulatory or inhibitory effect on, e.g., NOVX protein expression or NOVX protein activity. The invention also includes compounds identified in the screening assays described herein.

In one embodiment, the invention provides assays for screening candidate or test compounds which bind to or modulate the activity of the membrane-bound form of an NOVX protein or polypeptide or biologically-active portion thereof. The test compounds of the invention can be obtained using any of the numerous approaches in combinatorial library methods known in the art, including: biological libraries; spatially addressable parallel solid phase or solution phase libraries; synthetic library methods requiring deconvolution; the "one-bead one-compound" library method; and synthetic library methods using affinity chromatography selection. The biological library approach is limited to peptide libraries, while the other four approaches are applicable to peptide, non-peptide oligomer or small molecule libraries of compounds. See, e.g., Lam, 1997. *Anticancer Drug Design* 12: 145.

A "small molecule" as used herein, is meant to refer to a composition that has a molecular weight of less than about 5 kD and most preferably less than about 4 kD. Small molecules can be, e.g., nucleic acids, peptides, polypeptides, peptidomimetics, carbohydrates, lipids or other organic or inorganic molecules. Libraries of chemical and/or biological mixtures, such as fungal, bacterial, or algal extracts, are known in the art and can be screened with any of the assays of the invention.

Examples of methods for the synthesis of molecular libraries can be found in the art, for example in: DeWitt, et al., 1993. *Proc. Natl. Acad. Sci. U.S.A.* 90: 6909; Erb, et al., 1994. *Proc. Natl. Acad. Sci. U.S.A.* 91: 11422; Zuckermann, et al., 1994. *J. Med. Chem.* 37: 2678; Cho, et al., 1993. *Science* 261: 1303; Carrell, et al., 1994. *Angew. Chem. Int. Ed. Engl.* 33: 2059; Carell, et al., 1994. *Angew. Chem. Int. Ed. Engl.* 33: 2061; and Gallop, et al., 1994. *J. Med. Chem.* 37: 1233.

Libraries of compounds may be presented in solution (e.g., Houghten, 1992. *Biotechniques* 13: 412–421), or on beads (Lam, 1991. *Nature* 354: 82–84), on chips (Fodor, 1993. *Nature* 364: 555–556), bacteria (Ladner, U.S. Pat. No. 5,223,409), spores (Ladner, U.S. Pat. No. 5,233,409), plasmids (Cull, et al., 1992. *Proc. Natl. Acad. Sci. USA* 89: 1865–1869) or on phage (Scott and Smith, 1990. *Science* 249: 386–390; Devlin, 1990. *Science* 249: 404–406; Cwirla, et al., 1990. *Proc. Natl. Acad. Sci. U.S.A.* 87: 6378–6382; Felici, 1991. *J. Mol. Biol.* 222: 301–310; Ladner, U.S. Pat. No. 5,233,409.).

In one embodiment, an assay is a cell-based assay in which a cell which expresses a membrane-bound form of NOVX protein, or a biologically-active portion thereof, on the cell surface is contacted with a test compound and the ability of the test compound to bind to an NOVX protein determined. The cell, for example, can of mammalian origin or a yeast cell. Determining the ability of the test compound to bind to the NOVX protein can be accomplished, for example, by coupling the test compound with a radioisotope or enzymatic label such that binding of the test compound to the NOVX protein or biologically-active portion thereof can be determined by detecting the labeled compound in a complex. For example, test compounds can be labeled with $^{125}I$, $^{35}S$, $^{14}C$, or $^{3}H$, either directly or indirectly, and the radioisotope detected by direct counting of radioemission or by scintillation counting. Alternatively, test compounds can be enzymatically-labeled with, for example, horseradish peroxidase, alkaline phosphatase, or luciferase, and the enzymatic label detected by determination of conversion of an appropriate substrate to product. In one embodiment, the assay comprises contacting a cell which expresses a membrane-bound form of NOVX protein, or a biologically-active portion thereof, on the cell surface with a known compound which binds NOVX to form an assay mixture, contacting the assay mixture with a test compound, and determining the ability of the test compound to interact with an NOVX protein, wherein determining the ability of the test compound to interact with an NOVX protein comprises determining the ability of the test compound to preferentially bind to NOVX protein or a biologically-active portion thereof as compared to the known compound.

In another embodiment, an assay is a cell-based assay comprising contacting a cell expressing a membrane-bound form of NOVX protein, or a biologically-active portion thereof, on the cell surface with a test compound and determining the ability of the test compound to modulate (e.g., stimulate or inhibit) the activity of the NOVX protein or biologically-active portion thereof. Determining the ability of the test compound to modulate the activity of NOVX or a biologically-active portion thereof can be accomplished, for example, by determining the ability of the NOVX protein to bind to or interact with an NOVX target molecule. As used herein, a "target molecule" is a molecule with which an NOVX protein binds or interacts in nature, for example, a molecule on the surface of a cell which expresses an NOVX interacting protein, a molecule on the surface of a second cell, a molecule in the extracellular milieu, a molecule associated with the internal surface of a cell membrane or a cytoplasmic molecule. An NOVX target molecule can be a non-NOVX molecule or an NOVX protein or polypeptide of the invention. In one embodiment, an NOVX target molecule is a component of a signal transduction pathway that facilitates transduction of an extracellular signal (e.g. a signal generated by binding of a compound to a membrane-bound NOVX molecule) through the cell membrane and into the cell. The target, for example, can be a second intercellular protein that has catalytic activity or a protein that facilitates the association of downstream signaling molecules with NOVX.

Determining the ability of the NOVX protein to bind to or interact with an NOVX target molecule can be accomplished by one of the methods described above for determining direct binding. In one embodiment, determining the ability of the NOVX protein to bind to or interact with an NOVX target molecule can be accomplished by determining the activity of the target molecule. For example, the activity of the target molecule can be determined by detecting induction of a cellular second messenger of the target (i.e. intracellular $Ca^{2+}$, diacylglycerol, $IP_3$, etc.), detecting catalytic/enzymatic activity of the target an appropriate substrate, detecting the induction of a reporter gene (comprising an NOVX-responsive regulatory element operatively linked to a nucleic acid encoding a detectable marker, e.g., luciferase), or detecting a cellular response, for example, cell survival, cellular differentiation, or cell proliferation.

In yet another embodiment, an assay of the invention is a cell-free assay comprising contacting an NOVX protein or biologically-active portion thereof with a test compound and determining the ability of the test compound to bind to the NOVX protein or biologically-active portion thereof. Binding of the test compound to the NOVX protein can be determined either directly or indirectly as described above. In one such embodiment, the assay comprises contacting the NOVX protein or biologically-active portion thereof with a known compound which binds NOVX to form an assay mixture, contacting the assay mixture with a test compound, and determining the ability of the test compound to interact with an NOVX protein, wherein determining the ability of the test compound to interact with an NOVX protein comprises determining the ability of the test compound to preferentially bind to NOVX or biologically-active portion thereof as compared to the known compound.

In still another embodiment, an assay is a cell-free assay comprising contacting NOVX protein or biologically-active portion thereof with a test compound and determining the ability of the test compound to modulate (e.g. stimulate or inhibit) the activity of the NOVX protein or biologically-active portion thereof. Determining the ability of the test compound to modulate the activity of NOVX can be accomplished, for example, by determining the ability of the NOVX protein to bind to an NOVX target molecule by one of the methods described above for determining direct binding. In an alternative embodiment, determining the ability of the test compound to modulate the activity of NOVX protein can be accomplished by determining the ability of the NOVX protein further modulate an NOVX target molecule. For example, the catalytic/enzymatic activity of the target molecule on an appropriate substrate can be determined as described, supra.

In yet another embodiment, the cell-free assay comprises contacting the NOVX protein or biologically-active portion thereof with a known compound which binds NOVX protein to form an assay mixture, contacting the assay mixture with a test compound, and determining the ability of the test compound to interact with an NOVX protein, wherein determining the ability of the test compound to interact with an NOVX protein comprises determining the ability of the NOVX protein to preferentially bind to or modulate the activity of an NOVX target molecule.

The cell-free assays of the invention are amenable to use of both the soluble form or the membrane-bound form of NOVX protein. In the case of cell-free assays comprising the membrane-bound form of NOVX protein, it may be desirable to utilize a solubilizing agent such that the membrane-bound form of NOVX protein is maintained in solution. Examples of such solubilizing agents include non-ionic detergents such as n-octylglucoside, n-dodecylglucoside, n-dodecylmaltoside, octanoyl-N-methylglucamide, decanoyl-N-methylglucamide, Triton® X-100, Triton® X-114, Thesit®, Isotridecypoly(ethylene glycol ether)$_n$, N-dodecyl-N,N-dimethyl-3-ammonio-1-propane sulfonate, 3-(3-cholamidopropyl)dimethylamminiol-1-propane sulfonate (CHAPS), or 3-(3-cholamidopropyl) dimethylamminiol-2-hydroxy-1-propane sulfonate (CHAPSO).

In more than one embodiment of the above assay methods of the invention, it may be desirable to immobilize either NOVX protein or its target molecule to facilitate separation of complexed from uncomplexed forms of one or both of the proteins, as well as to accommodate automation of the assay. Binding of a test compound to NOVX protein, or interaction of NOVX protein with a target molecule in the presence and absence of a candidate compound, can be accomplished in any vessel suitable for containing the reactants. Examples of such vessels include microtiter plates, test tubes, and microcentrifuge tubes. In one embodiment, a fusion protein can be provided that adds a domain that allows one or both of the proteins to be bound to a matrix. For example, GST-NOVX fusion proteins or GST-target fusion proteins can be adsorbed onto glutathione sepharose beads (Sigma Chemical, St. Louis, Mo.) or glutathione derivatized microtiter plates, that are then combined with the test compound or the test compound and either the non-adsorbed target protein or NOVX protein, and the mixture is incubated under conditions conducive to complex formation (e.g., at physiological conditions for salt and pH). Following incubation, the beads or microtiter plate wells are washed to remove any unbound components, the matrix immobilized in the case of beads, complex determined either directly or indirectly, for example, as described, supra. Alternatively, the complexes can be dissociated from the matrix, and the level of NOVX protein binding or activity determined using standard techniques.

Other techniques for immobilizing proteins on matrices can also be used in the screening assays of the invention. For example, either the NOVX protein or its target molecule can be immobilized utilizing conjugation of biotin and streptavidin. Biotinylated NOVX protein or target molecules can be prepared from biotin-NHS (N-hydroxy-succinimide) using techniques well-known within the art (e.g., biotinylation kit, Pierce Chemicals, Rockford, Ill.), and immobilized in the wells of streptavidin-coated 96 well plates (Pierce Chemical). Alternatively, antibodies reactive with NOVX protein or target molecules, but which do not interfere with binding of the NOVX protein to its target molecule, can be derivatized to the wells of the plate, and unbound target or NOVX protein trapped in the wells by antibody conjugation. Methods for detecting such complexes, in addition to those described above for the GST-immobilized complexes, include immunodetection of complexes using antibodies reactive with the NOVX protein or target molecule, as well as enzyme-linked assays that rely on detecting an enzymatic activity associated with the NOVX protein or target molecule.

In another embodiment, modulators of NOVX protein expression are identified in a method wherein a cell is contacted with a candidate compound and the expression of NOVX mRNA or protein in the cell is determined. The level of expression of NOVX mRNA or protein in the presence of the candidate compound is compared to the level of expression of NOVX mRNA or protein in the absence of the candidate compound. The candidate compound can then be identified as a modulator of NOVX mRNA or protein expression based upon this comparison. For example, when expression of NOVX mRNA or protein is greater (i.e., statistically significantly greater) in the presence of the candidate compound than in its absence, the candidate compound is identified as a stimulator of NOVX mRNA or protein expression. Alternatively, when expression of NOVX mRNA or protein is less (statistically significantly less) in the presence of the candidate compound than in its absence, the candidate compound is identified as an inhibitor of NOVX mRNA or protein expression. The level of NOVX mRNA or protein expression in the cells can be determined by methods described herein for detecting NOVX mRNA or protein.

In yet another aspect of the invention, the NOVX proteins can be used as "bait proteins" in a two-hybrid assay or three hybrid assay (see, e.g., U.S. Pat. No. 5,283,317; Zervos, et al., 1993. *Cell* 72: 223–232; Madura, et al., 1993. *J. Biol. Chem.* 268: 12046–12054; Bartel, et al., 1993. *Biotechniques* 14: 920–924; Iwabuchi, et al., 1993. *Oncogene* 8: 1693–1696; and Brent WO 94/10300), to identify other proteins that bind to or interact with NOVX ("NOVX-binding proteins" or "NOVX-bp") and modulate NOVX activity. Such NOVX-binding proteins are also likely to be involved in the propagation of signals by the NOVX proteins as, for example, upstream or downstream elements of the NOVX pathway.

The two-hybrid system is based on the modular nature of most transcription factors, which consist of separable DNA-binding and activation domains. Briefly, the assay utilizes two different DNA constructs. In one construct, the gene that codes for NOVX is fused to a gene encoding the DNA binding domain of a known transcription factor (e.g., GAL-4). In the other construct, a DNA sequence, from a library of DNA sequences, that encodes an unidentified protein ("prey" or "sample") is fused to a gene that codes for the activation domain of the known transcription factor. If the "bait" and the "prey" proteins are able to interact, in vivo, forming an NOVX-dependent complex, the DNA-binding and activation domains of the transcription factor are brought into close proximity. This proximity allows transcription of a reporter gene (e.g., LacZ) that is operably linked to a transcriptional regulatory site responsive to the transcription factor. Expression of the reporter gene can be detected and cell colonies containing the functional transcription factor can be isolated and used to obtain the cloned gene that encodes the protein which interacts with NOVX.

The invention further pertains to novel agents identified by the aforementioned screening assays and uses thereof for treatments as described herein.

Detection Assays

Portions or fragments of the cDNA sequences identified herein (and the corresponding complete gene sequences) can be used in numerous ways as polynucleotide reagents. By way of example, and not of limitation, these sequences can be used to: (i) map their respective genes on a chromosome; and, thus, locate gene regions associated with genetic disease; (ii) identify an individual from a minute biological sample (tissue typing); and (iii) aid in forensic identification of a biological sample. Some of these applications are described in the subsections, below.

Chromosome Mapping

Once the sequence (or a portion of the sequence) of a gene has been isolated, this sequence can be used to map the location of the gene on a chromosome. This process is called chromosome mapping. Accordingly, portions or fragments of the NOVX sequences, SEQ ID NOS:1, 3, 5, 7, 9, 11, 13, 15, 17, 19, 21, 23, 25, 27, 29, 31, and 217, or fragments or derivatives thereof, can be used to map the location of the NOVX genes, respectively, on a chromosome. The mapping of the NOVX sequences to chromosomes is an important first step in correlating these sequences with genes associated with disease.

Briefly, NOVX genes can be mapped to chromosomes by preparing PCR primers (preferably 15–25 bp in length) from the NOVX sequences. Computer analysis of the NOVX, sequences can be used to rapidly select primers that do not span more than one exon in the genomic DNA, thus complicating the amplification process. These primers can then be used for PCR screening of somatic cell hybrids containing individual human chromosomes. Only those hybrids containing the human gene corresponding to the NOVX sequences will yield an amplified fragment.

Somatic cell hybrids are prepared by fusing somatic cells from different mammals (e.g., human and mouse cells). As hybrids of human and mouse cells grow and divide, they gradually lose human chromosomes in random order, but retain the mouse chromosomes. By using media in which mouse cells cannot grow, because they lack a particular enzyme, but in which human cells can, the one human chromosome that contains the gene encoding the needed enzyme will be retained. By using various media, panels of hybrid cell lines can be established. Each cell line in a panel contains either a single human chromosome or a small number of human chromosomes, and a full set of mouse chromosomes, allowing easy mapping of individual genes to specific human chromosomes. See, e.g., D'Eustachio, et al., 1983. *Science* 220: 919–924. Somatic cell hybrids containing only fragments of human chromosomes can also be produced by using human chromosomes with translocations and deletions.

PCR mapping of somatic cell hybrids is a rapid procedure for assigning a particular sequence to a particular chromosome. Three or more sequences can be assigned per day using a single thermal cycler. Using the NOVX sequences to design oligonucleotide primers, sub-localization can be achieved with panels of fragments from specific chromosomes.

Fluorescence in situ hybridization (FISH) of a DNA sequence to a metaphase chromosomal spread can further be used to provide a precise chromosomal location in one step. Chromosome spreads can be made using cells whose division has been blocked in metaphase by a chemical like colcemid that disrupts the mitotic spindle. The chromosomes can be treated briefly with trypsin, and then stained with Giemsa. A pattern of light and dark bands develops on each chromosome, so that the chromosomes can be identified individually. The FISH technique can be used with a DNA sequence as short as 500 or 600 bases. However, clones larger than 1,000 bases have a higher likelihood of binding to a unique chromosomal location with sufficient signal intensity for simple detection. Preferably 1,000 bases, and more preferably 2,000 bases, will suffice to get good results at a reasonable amount of time. For a review of this technique, see, Verma, et al., HUMAN CHROMOSOMES: A MANUAL OF BASIC TECHNIQUES (Pergamon Press, New York 1988).

Reagents for chromosome mapping can be used individually to mark a single chromosome or a single site on that chromosome, or panels of reagents can be used for marking multiple sites and/or multiple chromosomes. Reagents corresponding to noncoding regions of the genes actually are preferred for mapping purposes. Coding sequences are more likely to be conserved within gene families, thus increasing the chance of cross hybridizations during chromosomal mapping.

Once a sequence has been mapped to a precise chromosomal location, the physical position of the sequence on the chromosome can be correlated with genetic map data. Such data are found, e.g., in McKusick, MENDELIAN INHERITANCE IN MAN, available on-line through Johns Hopkins University Welch Medical Library). The relationship between genes and disease, mapped to the same chromosomal region, can then be identified through linkage analysis (co-inheritance of physically adjacent genes), described in, e.g., Egeland, et al., 1987. *Nature,* 325: 783–787.

Moreover, differences in the DNA sequences between individuals affected and unaffected with a disease associated with the NOVX gene, can be determined. If a mutation is observed in some or all of the affected individuals but not in any unaffected individuals, then the mutation is likely to be the causative agent of the particular disease. Comparison of affected and unaffected individuals generally involves first looking for structural alterations in the chromosomes, such as deletions or translocations that are visible from chromosome spreads or detectable using PCR based on that DNA sequence. Ultimately, complete sequencing of genes from several individuals can be performed to confirm the presence of a mutation and to distinguish mutations from polymorphisms.

Tissue Typing

The NOVX sequences of the invention can also be used to identify individuals from minute biological samples. In this technique, an individual's genomic DNA is digested with one or more restriction enzymes, and probed on a Southern blot to yield unique bands for identification. The sequences of the invention are useful as additional DNA markers for RFLP ("restriction fragment length polymorphisms," described in U.S. Pat. No. 5,272,057).

Furthermore, the sequences of the invention can be used to provide an alternative technique that determines the actual base-by-base DNA sequence of selected portions of an individual's genome. Thus, the NOVX sequences described herein can be used to prepare two PCR primers from the 5'- and 3'-termini of the sequences. These primers can then be used to amplify an individual's DNA and subsequently sequence it.

Panels of corresponding DNA sequences from individuals, prepared in this manner, can provide unique individual identifications, as each individual will have a unique set of such DNA sequences due to allelic differences. The sequences of the invention can be used to obtain such identification sequences from individuals and from tissue. The NOVX sequences of the invention uniquely represent portions of the human genome. Allelic variation occurs to some degree in the coding regions of these sequences, and to a greater degree in the noncoding regions. It is estimated that allelic variation between individual humans occurs with a frequency of about once per each 500 bases. Much of the allelic variation is due to single nucleotide polymorphisms (SNPs), which include restriction fragment length polymorphisms (RFLPs).

Each of the sequences described herein can, to some degree, be used as a standard against which DNA from an individual can be compared for identification purposes. Because greater numbers of polymorphisms occur in the noncoding regions, fewer sequences are necessary to differentiate individuals. The noncoding sequences can comfortably provide positive individual identification with a panel of perhaps 10 to 1,000 primers that each yield a noncoding amplified sequence of 100 bases. If predicted coding sequences, such as those in SEQ ID NOS:1, 3, 5, 7, 9, 11, 13, 15, 17, 19, 21, 23, 25, 27, 29, 31, and 217 are used, a more appropriate number of primers for positive individual identification would be 500–2,000.

Predictive Medicine

The invention also pertains to the field of predictive medicine in which diagnostic assays, prognostic assays, pharmacogenomics, and monitoring clinical trials are used for prognostic (predictive) purposes to thereby treat an individual prophylactically. Accordingly, one aspect of the invention relates to diagnostic assays for determining NOVX protein and/or nucleic acid expression as well as NOVX activity, in the context of a biological sample (e.g., blood, serum, cells, tissue) to thereby determine whether an individual is afflicted with a disease or disorder, or is at risk of developing a disorder, associated with aberrant NOVX expression or activity. The disorders include metabolic disorders, diabetes, obesity, infectious disease, anorexia, cancer-associated cachexia, cancer, neurodegenerative disorders, Alzheimer's Disease, Parkinson's Disorder, immune disorders, and hematopoietic disorders, and the various dyslipidemias, metabolic disturbances associated with obesity, the metabolic syndrome X and wasting disorders associated with chronic diseases and various cancers. The invention also provides for prognostic (or predictive) assays for determining whether an individual is at risk of developing a disorder associated with NOVX protein, nucleic acid expression or activity. For example, mutations in an NOVX gene can be assayed in a biological sample. Such assays can be used for prognostic or predictive purpose to thereby prophylactically treat an individual prior to the onset of a disorder characterized by or associated with NOVX protein, nucleic acid expression, or biological activity.

Another aspect of the invention provides methods for determining NOVX protein, nucleic acid expression or activity in an individual to thereby select appropriate therapeutic or prophylactic agents for that individual (referred to herein as "pharmacogenomics"). Pharmacogenomics allows for the selection of agents (e.g., drugs) for therapeutic or prophylactic treatment of an individual based on the genotype of the individual (e.g., the genotype of the individual examined to determine the ability of the individual to respond to a particular agent.)

Yet another aspect of the invention pertains to monitoring the influence of agents (e.g., drugs, compounds) on the expression or activity of NOVX in clinical trials.

These and other agents are described in further detail in the following sections.

Diagnostic Assays

An exemplary method for detecting the presence or absence of NOVX in a biological sample involves obtaining a biological sample from a test subject and contacting the biological sample with a compound or an agent capable of detecting NOVX protein or nucleic acid (e.g., mRNA, genomic DNA) that encodes NOVX protein such that the presence of NOVX is detected in the biological sample. An agent for detecting NOVX mRNA or genomic DNA is a labeled nucleic acid probe capable of hybridizing to NOVX mRNA or genomic DNA. The nucleic acid probe can be, for example, a full-length NOVX nucleic acid, such as the nucleic acid of SEQ ID NOS:1, 3, 5, 7, 9, 11, 13, 15, 17, 19, 21, 23, 25, 27, 29, 31, and 217, or a portion thereof, such as an oligonucleotide of at least 15, 30, 50, 100, 250 or 500 nucleotides in length and sufficient to specifically hybridize under stringent conditions to NOVX mRNA or genomic DNA. Other suitable probes for use in the diagnostic assays of the invention are described herein.

An agent for detecting NOVX protein is an antibody capable of binding to NOVX protein, preferably an antibody with a detectable label. Antibodies can be polyclonal, or more preferably, monoclonal. An intact antibody, or a fragment thereof (e.g., Fab or F(ab')$_2$) can be used. The term "labeled", with regard to the probe or antibody, is intended to encompass direct labeling of the probe or antibody by coupling (i.e., physically linking) a detectable substance to the probe or antibody, as well as indirect labeling of the probe or antibody by reactivity with another reagent that is directly labeled. Examples of indirect labeling include detection of a primary antibody using a fluorescently-labeled secondary antibody and end-labeling of a DNA probe with biotin such that it can be detected with fluorescently-labeled streptavidin. The term "biological sample" is intended to include tissues, cells and biological fluids isolated from a subject, as well as tissues, cells and fluids present within a subject. That is, the detection method of the invention can be used to detect NOVX mRNA, protein, or genomic DNA in a biological sample in vitro as well as in vivo. For example, in vitro techniques for detection of NOVX mRNA include Northern hybridizations and in situ hybridizations. In vitro techniques for detection of NOVX protein include enzyme linked immunosorbent assays (ELISAs), Western blots, immunoprecipitations, and immunofluorescence. In vitro techniques for detection of NOVX genomic DNA include Southern hybridizations. Furthermore, in vivo techniques for detection of NOVX protein include introducing into a subject a labeled anti-NOVX antibody. For example, the antibody can be labeled with a radioactive marker whose presence and location in a subject can be detected by standard imaging techniques.

In one embodiment, the biological sample contains protein molecules from the test subject. Alternatively, the biological sample can contain mRNA molecules from the test subject or genomic DNA molecules from the test subject. A preferred biological sample is a peripheral blood leukocyte sample isolated by conventional means from a subject.

In another embodiment, the methods further involve obtaining a control biological sample from a control subject, contacting the control sample with a compound or agent capable of detecting NOVX protein, mRNA, or genomic DNA, such that the presence of NOVX protein, mRNA or genomic DNA is detected in the biological sample, and comparing the presence of NOVX protein, mRNA or genomic DNA in the control sample with the presence of NOVX protein, mRNA or genomic DNA in the test sample.

The invention also encompasses kits for detecting the presence of NOVX in a biological sample. For example, the kit can comprise: a labeled compound or agent capable of detecting NOVX protein or mRNA in a biological sample; means for determining the amount of NOVX in the sample; and means for comparing the amount of NOVX in the sample with a standard. The compound or agent can be packaged in a suitable container. The kit can further comprise instructions for using the kit to detect NOVX protein or nucleic acid.

Prognostic Assays

The diagnostic methods described herein can furthermore be utilized to identify subjects having or at risk of developing a disease or disorder associated with aberrant NOVX expression or activity. For example, the assays described herein, such as the preceding diagnostic assays or the following assays, can be utilized to identify a subject having or at risk of developing a disorder associated with NOVX protein, nucleic acid expression or activity. Alternatively, the prognostic assays can be utilized to identify a subject having or at risk for developing a disease or disorder. Thus, the invention provides a method for identifying a disease or disorder associated with aberrant NOVX expression or activity in which a test sample is obtained from a subject and NOVX protein or nucleic acid (e.g., mRNA, genomic DNA) is detected, wherein the presence of NOVX protein or nucleic acid is diagnostic for a subject having or at risk of developing a disease or disorder associated with aberrant NOVX expression or activity. As used herein, a "test sample" refers to a biological sample obtained from a subject of interest. For example, a test sample can be a biological fluid (e.g., serum), cell sample, or tissue.

Furthermore, the prognostic assays described herein can be used to determine whether a subject can be administered an agent (e.g., an agonist, antagonist, peptidomimetic, protein, peptide, nucleic acid, small molecule, or other drug candidate) to treat a disease or disorder associated with aberrant NOVX expression or activity. For example, such methods can be used to determine whether a subject can be effectively treated with an agent for a disorder. Thus, the invention provides methods for determining whether a subject can be effectively treated with an agent for a disorder associated with aberrant NOVX expression or activity in which a test sample is obtained and NOVX protein or nucleic acid is detected (e.g., wherein the presence of NOVX protein or nucleic acid is diagnostic for a subject that can be administered the agent to treat a disorder associated with aberrant NOVX expression or activity).

The methods of the invention can also be used to detect genetic lesions in an NOVX gene, thereby determining if a subject with the lesioned gene is at risk for a disorder characterized by aberrant cell proliferation and/or differentiation. In various embodiments, the methods include detecting, in a sample of cells from the subject, the presence or absence of a genetic lesion characterized by at least one of an alteration affecting the integrity of a gene encoding an NOVX-protein, or the misexpression of the NOVX gene. For example, such genetic lesions can be detected by ascertaining the existence of at least one of: (i) a deletion of one or more nucleotides from an NOVX gene; (ii) an addition of one or more nucleotides to an NOVX gene; (iii) a substitution of one or more nucleotides of an NOVX gene, (iv) a chromosomal rearrangement of an NOVX gene; (v) an alteration in the level of a messenger RNA transcript of an NOVX gene, (vi) aberrant modification of an NOVX gene, such as of the methylation pattern of the genomic DNA, (vii) the presence of a non-wild-type splicing pattern of a messenger RNA transcript of an NOVX gene, (viii) a non-wild-type level of an NOVX protein, (ix) allelic loss of an NOVX gene, and (x) inappropriate post-translational modification of an NOVX protein. As described herein, there are a large number of assay techniques known in the art which can be used for detecting lesions in an NOVX gene. A preferred biological sample is a peripheral blood leukocyte sample isolated by conventional means from a subject. However, any biological sample containing nucleated cells may be used, including, for example, buccal mucosal cells.

In certain embodiments, detection of the lesion involves the use of a probe/primer in a polymerase chain reaction (PCR) (see, e.g., U.S. Pat. Nos. 4,683,195 and 4,683,202), such as anchor PCR or RACE PCR, or, alternatively, in a ligation chain reaction (LCR) (see, e.g., Landegran, et al., 1988. *Scieice* 241: 1077–1080; and Nakazawa, et al., 1994. *Proc. Natl. Acad. Sci. USA* 91: 360–364), the latter of which can be particularly useful for detecting point mutations in the NOVX-gene (see, Abravaya, et al., 1995. *Nucl. Acids Res.* 23: 675–682). This method can include the steps of collecting a sample of cells from a patient, isolating nucleic acid (e.g., genomic, mRNA or both) from the cells of the sample, contacting the nucleic acid sample with one or more primers that specifically hybridize to an NOVX gene under conditions such that hybridization and amplification of the NOVX gene (if present) occurs, and detecting the presence or absence of an amplification product, or detecting the size of the amplification product and comparing the length to a control sample. It is anticipated that PCR and/or LCR may be desirable to use as a preliminary amplification step in conjunction with any of the techniques used for detecting mutations described herein.

Alternative amplification methods include: self sustained sequence replication (see, Guatelli, et al., 1990. *Proc. Natl. Acad. Sci. USA* 87: 1874–1878), transcriptional amplification system (see, Kwoh, et al., 1989. *Proc. Natl. Acad. Sci. USA* 86: 1173–1177); Qβ Replicase (see, Lizardi, et al, 1988. *BioTechtnology* 6: 1197), or any other nucleic acid amplification method, followed by the detection of the amplified molecules using techniques well known to those of skill in the art. These detection schemes are especially useful for the detection of nucleic acid molecules if such molecules are present in very low numbers.

In an alternative embodiment, mutations in an NOVX gene from a sample cell can be identified by alterations in restriction enzyme cleavage patterns. For example, sample and control DNA is isolated, amplified (optionally), digested with one or more restriction endonucleases, and fragment length sizes are determined by gel electrophoresis and compared. Differences in fragment length sizes between sample and control DNA indicates mutations in the sample DNA. Moreover, the use of sequence specific ribozymes (see, e.g., U.S. Pat. No. 5,493,531) can be used to score for the presence of specific mutations by development or loss of a ribozyme cleavage site.

In other embodiments, genetic mutations in NOVX can be identified by hybridizing a sample and control nucleic acids, e.g., DNA or RNA, to high-density arrays containing hundreds or thousands of oligonucleotides probes. See, e.g., Cronin, et al., 1996. *Human Mutation* 7: 244–255; Kozal, et al., 1996. *Nat. Med.* 2: 753–759. For example, genetic mutations in NOVX can be identified in two dimensional arrays containing light-generated DNA probes as described in Cronin, et al., supra. Briefly, a first hybridization array of probes can be used to scan through long stretches of DNA in a sample and control to identify base changes between the sequences by making linear arrays of sequential overlapping probes. This step allows the identification of point mutations. This is followed by a second hybridization array that allows the characterization of specific mutations by using smaller, specialized probe arrays complementary to all variants or mutations detected. Each mutation array is composed of parallel probe sets, one complementary to the wild-type gene and the other complementary to the mutant gene.

In yet another embodiment, any of a variety of sequencing reactions known in the art can be used to directly sequence the NOVX gene and detect mutations by comparing the sequence of the sample NOVX with the corresponding wild-type (control) sequence. Examples of sequencing reactions include those based on techniques developed by Maxim and Gilbert, 1977. *Proc. Natl. Acad. Sci. USA* 74: 560 or Sanger, 1977. *Proc. Natl. Acad. Sci. USA* 74: 5463. It is also contemplated that any of a variety of automated sequencing procedures can be utilized when performing the diagnostic assays (see, e.g., Naeve, et al., 1995. *Biotechniques* 19: 448), including sequencing by mass spectrometry (see, e.g., PCT International Publication No. WO 94/16101; Cohen, et al., 1996. *Adv. Chromatography* 36: 127–162; and Griffin, et al., 1993. *Appl. Biochem. Biotechnol.* 38: 147–159).

Other methods for detecting mutations in the NOVX gene include methods in which protection from cleavage agents is used to detect mismatched bases in RNA/RNA or RNA/DNA heteroduplexes. See, e.g., Myers, et al., 1985. *Science* 230: 1242. In general, the art technique of "mismatch cleavage" starts by providing heteroduplexes of formed by hybridizing (labeled) RNA or DNA containing the wild-type NOVX sequence with potentially mutant RNA or DNA obtained from a tissue sample. The double-stranded duplexes are treated with an agent that cleaves single-stranded regions of the duplex such as which will exist due to basepair mismatches between the control and sample strands. For instance, RNA/DNA duplexes can be treated with RNase and DNA/DNA hybrids treated with $S_1$ nuclease to enzymatically digesting the mismatched regions. In other embodiments, either DNA/DNA or RNA/DNA duplexes can be treated with hydroxylamine or osmium tetroxide and with piperidine in order to digest mismatched regions. After digestion of the mismatched regions, the resulting material is then separated by size on denaturing polyacrylamide gels to determine the site of mutation. See, e.g., Cotton, et al., 1988. *Proc. Natl. Acad. Sci. USA* 85: 4397; Saleeba, et al., 1992. *Methods Enzymol.* 217: 286–295. In an embodiment, the control DNA or RNA can be labeled for detection.

In still another embodiment, the mismatch cleavage reaction employs one or more proteins that recognize mismatched base pairs in double-stranded DNA (so called "DNA mismatch repair" enzymes) in defined systems for detecting and mapping point mutations in NOVX cDNAs obtained from samples of cells. For example, the mutY enzyme of *E. coli* cleaves A at G/A mismatches and the thymidine DNA glycosylase from HeLa cells cleaves T at G/T mismatches. See, e.g., Hsu, et al., 1994. *Carcinogenesis* 15: 1657–1662. According to an exemplary embodiment, a probe based on an NOVX sequence, e.g., a wild-type NOVX sequence, is hybridized to a cDNA or other DNA product from a test cell(s). The duplex is treated with a DNA mismatch repair enzyme, and the cleavage products, if any, can be detected from electrophoresis protocols or the like. See, e.g., U.S. Pat. No. 5,459,039.

In other embodiments, alterations in electrophoretic mobility will be used to identify mutations in NOVX genes. For example, single strand conformation polymorphism (SSCP) may be used to detect differences in electrophoretic mobility between mutant and wild type nucleic acids. See, e.g., Orita, et al., 1989. *Proc. Natl. Acad. Sci. USA:* 86: 2766; Cotton, 1993. *Mutat. Res.* 285: 125–144; Hayashi, 1992. *Genet. Anal. Tech. Appl.* 9: 73–79. Single-stranded DNA fragments of sample and control NOVX nucleic acids will be denatured and allowed to renature. The secondary structure of single-stranded nucleic acids varies according to sequence, the resulting alteration in electrophoretic mobility enables the detection of even a single base change. The DNA fragments may be labeled or detected with labeled probes. The sensitivity of the assay may be enhanced by using RNA (rather than DNA), in which the secondary structure is more sensitive to a change in sequence. In one embodiment, the subject method utilizes heteroduplex analysis to separate double stranded heteroduplex molecules on the basis of changes in electrophoretic mobility. See, e.g., Keen, et al., 1991. *Trends Genet.* 7: 5.

In yet another embodiment, the movement of mutant or wild-type fragments in polyacrylamide gels containing a gradient of denaturant is assayed using denaturing gradient gel electrophoresis (DGGE). See, e.g., Myers, et al., 1985. *Nature* 313: 495. When DGGE is used as the method of analysis, DNA will be modified to insure that it does not completely denature, for example by adding a GC clamp of approximately 40 bp of high-melting GC-rich DNA by PCR. In a further embodiment, a temperature gradient is used in place of a denaturing gradient to identify differences in the mobility of control and sample DNA. See, e.g., Rosenbaum and Reissner, 1987. *Biophys. Chem.* 265: 12753.

Examples of other techniques for detecting point mutations include, but are not limited to, selective oligonucleotide hybridization, selective amplification, or selective primer extension. For example, oligonucleotide primers may be prepared in which the known mutation is placed centrally and then hybridized to target DNA under conditions that penmit hybridization only if a perfect match is found. See, e.g., Saiki, et al., 1986. *Nature* 324: 163; Saiki, et al., 1989. *Proc. Natl. Acad. Sci. USA* 86: 6230. Such allele specific oligonucleotides are hybridized to PCR amplified target DNA or a number of different mutations when the oligonucleotides are attached to the hybridizing membrane and hybridized with labeled target DNA.

Alternatively, allele specific amplification technology that depends on selective PCR amplification may be used in conjunction with the instant invention. Oligonucleotides used as primers for specific amplification may carry the mutation of interest in the center of the molecule (so that amplification depends on differential hybridization; see, e.g., Gibbs, et al., 1989. *Nucl. Acids Res.* 17: 2437–2448) or at the extreme 3'-terminus of one primer where, under appropriate conditions, mismatch can prevent, or reduce polymerase extension (see, e.g., Prossner, 1993. *Tibtech.* 11: 238). In addition it may be desirable to introduce a novel restriction site in the region of the mutation to create cleavage-based detection. See, e.g., Gasparini, et al., 1992. *Mol. Cell Probes*

6: 1. It is anticipated that in certain embodiments amplification may also be performed using Taq ligase for amplification. See, e.g., Barany, 1991. *Proc. Natl. Acad. Sci. USA* 88: 189. In such cases, ligation will occur only if there is a perfect match at the 3'-terminus of the 5' sequence, making it possible to detect the presence of a known mutation at a specific site by looking for the presence or absence of amplification.

The methods described herein may be performed, for example, by utilizing pre-packaged diagnostic kits comprising at least one probe nucleic acid or antibody reagent described herein, which may be conveniently used, e.g., in clinical settings to diagnose patients exhibiting symptoms or family history of a disease or illness involving an NOVX gene.

Furthermore, any cell type or tissue, preferably peripheral blood leukocytes, in which NOVX is expressed may be utilized in the prognostic assays described herein. However, any biological sample containing nucleated cells may be used, including, for example, buccal mucosal cells.

Pharmacogenomics

Agents, or modulators that have a stimulatory or inhibitory effect on NOVX activity (e.g., NOVX gene expression), as identified by a screening assay described herein can be administered to individuals to treat (prophylactically or therapeutically) disorders (The disorders include metabolic disorders, diabetes, obesity, infectious disease, anorexia, cancer-associated cachexia, cancer, neurodegenerative disorders, Alzheimer's Disease, Parkinson's Disorder, immune disorders, and hematopoietic disorders, and the various dyslipidemias, metabolic disturbances associated with obesity, the metabolic syndrome X and wasting disorders associated with chronic diseases and various cancers.) In conjunction with such treatment, the pharmacogenomics (i.e., the study of the relationship between an individual's genotype and that individual's response to a foreign compound or drug) of the individual may be considered. Differences in metabolism of therapeutics can lead to severe toxicity or therapeutic failure by altering the relation between dose and blood concentration of the pharmacologically active drug. Thus, the pharniacogenomics of the individual permits the selection of effective agents (e.g., drugs) for prophylactic or therapeutic treatments based on a consideration of the individual's genotype. Such pharmacogenomics can further be used to determine appropriate dosages and therapeutic regimens. Accordingly, the activity of NOVX protein, expression of NOVX nucleic acid, or mutation content of NOVX genes in an individual can be determined to thereby select appropriate agent(s) for therapeutic or prophylactic treatment of the individual.

Pharmacogenomics deals with clinically significant hereditary variations in the response to drugs due to altered drug disposition and abnormal action in affected persons. See e.g., Eichelbaum, 1996. *Clin. Exp. Pharmacol. Physiol.*, 23: 983–985; Linder, 1997. *Clin. Chem.*, 43: 254–266. In general, two types of pharmacogenetic conditions can be differentiated. Genetic conditions transmitted as a single factor altering the way drugs act on the body (altered drug action) or genetic conditions transmitted as single factors altering the way the body acts on drugs (altered drug metabolism). These pharmacogenetic conditions can occur either as rare defects or as polymorphisms. For example, glucose-6-phosphate dehydrogenase (G6PD) deficiency is a common inherited enzymopathy in which the main clinical complication is hemolysis after ingestion of oxidant drugs (anti-malarials, sulfonamides, analgesics, nitrofurans) and consumption of fava beans.

As an illustrative embodiment, the activity of drug metabolizing enzymes is a major determinant of both the intensity and duration of drug action. The discovery of genetic polymorphisms of drug metabolizing enzymes (e.g., N-acetyltransferase 2 (NAT 2) and cytochrome P450 enzymes CYP2D6 and CYP2C19) has provided an explanation as to why some patients do not obtain the expected drug effects or show exaggerated drug response and serious toxicity after taking the standard and safe dose of a drug. These polymorphisms are expressed in two phenotypes in the population, the extensive metabolizer (EM) and poor metabolizer (PM). The prevalence of PM is different among different populations. For example, the gene coding for CYP2D6 is highly polymorphic and several mutations have been identified in PM, which all lead to the absence of functional CYP2D6. Poor metabolizers of CYP2D6 and CYP2C19 quite frequently experience exaggerated drug response and side effects when they receive standard doses. If a metabolite is the active therapeutic moiety, PM show no therapeutic response, as demonstrated for the analgesic effect of codeine mediated by its CYP2D6-formed metabolite morphine. At the other extreme are the so called ultra-rapid metabolizers who do not respond to standard doses. Recently, the molecular basis of ultra-rapid metabolism has been identified to be due to CYP2D6 gene amplification.

Thus, the activity of NOVX protein, expression of NOVX nucleic acid, or mutation content of NOVX genes in an individual can be determined to thereby select appropriate agent(s) for therapeutic or prophylactic treatment of the individual. In addition, pharmacogenetic studies can be used to apply genotyping of polymorphic alleles encoding drug-metabolizing enzymes to the identification of an individual's drug responsiveness phenotype. This knowledge, when applied to dosing or drug selection, can avoid adverse reactions or therapeutic failure and thus enhance therapeutic or prophylactic efficiency when treating a subject with an NOVX modulator, such as a modulator identified by one of the exemplary screening assays described herein.

Monitoring of Effects During Clinical Trials

Monitoring the influence of agents (e.g., drugs, compounds) on the expression or activity of NOVX (e.g., the ability to modulate aberrant cell proliferation and/or differentiation) can be applied not only in basic drug screening, but also in clinical trials. For example, the effectiveness of an agent determined by a screening assay as described herein to increase NOVX gene expression, protein levels, or upregulate NOVX activity, can be monitored in clinical trails of subjects exhibiting decreased NOVX gene expression, protein levels, or downregulated NOVX activity. Alternatively, the effectiveness of an agent determined by a screening assay to decrease NOVX gene expression, protein levels, or downregulate NOVX activity, can be monitored in clinical trails of subjects exhibiting increased NOVX gene expression, protein levels, or upregulated NOVX activity. In such clinical trials, the expression or activity of NOVX and, preferably, other genes that have been implicated in, for example, a cellular proliferation or immune disorder can be used as a "read out" or markers of the immune responsiveness of a particular cell.

By way of example, and not of limitation, genes, including NOVX, that are modulated in cells by treatment with an agent (e.g., compound, drug or small molecule) that modulates NOVX activity (e.g., identified in a screening assay as described herein) can be identified. Thus, to study the effect of agents on cellular proliferation disorders, for example, in a clinical trial, cells can be isolated and RNA prepared and analyzed for the levels of expression of NOVX and other genes implicated in the disorder. The levels of gene expression (i.e., a gene expression pattern) can be quantified by Northern blot analysis or RT-PCR, as described herein, or alternatively by measuring the amount of protein produced, by one of the methods as described herein, or by measuring the levels of activity of NOVX or other genes. In this manner, the gene expression pattern can serve as a marker, indicative of the physiological response of the cells to the agent. Accordingly, this response state may be determined before, and at various points during, treatment of the individual with the agent.

In one embodiment, the invention provides a method for monitoring the effectiveness of treatment of a subject with an agent (e.g., an agonist, antagonist, protein, peptide, peptidomimetic, nucleic acid, small molecule, or other drug candidate identified by the screening assays described herein) comprising the steps of (i) obtaining a pre-administration sample from a subject prior to administration of the agent; (ii) detecting the level of expression of an NOVX protein, mRNA, or genomic DNA in the preadministration sample; (iii) obtaining one or more post-administration samples from the subject; (iv) detecting the level of expression or activity of the NOVX protein, mRNA, or genomic DNA in the post-administration samples; (v) comparing the level of expression or activity of the NOVX protein, mRNA, or genomic DNA in the pre-administration sample with the NOVX protein, mRNA, or genomic DNA in the post administration sample or samples; and (vi) altering the administration of the agent to the subject accordingly. For example, increased administration of the agent may be desirable to increase the expression or activity of NOVX to higher levels than detected, i.e., to increase the effectiveness of the agent. Alternatively, decreased administration of the agent may be desirable to decrease expression or activity of NOVX to lower levels than detected, i.e., to decrease the effectiveness of the agent.

Methods of Treatment

The invention provides for both prophylactic and therapeutic methods of treating a subject at risk of (or susceptible to) a disorder or having a disorder associated with aberrant NOVX expression or activity. The disorders include cardiomyopathy, atherosclerosis, hypertension, congenital heart defects, aortic stenosis, atrial septal defect (ASD), atrioventricular (A-V) canal defect, ductus arteriosus, pulmonary stenosis, subaortic stenosis, ventricular septal defect (VSD), valve diseases, tuberous sclerosis, scleroderma, obesity, transplantation, adrenoleukodystrophy, congenital adrenal hyperplasia, prostate cancer, neoplasm; adenocarcinoma, lymphoma, uterus cancer, fertility, hemophilia, hypercoagulation, idiopathic thrombocytopenic purpura, immunodeficiencies, graft versus host disease, AIDS, bronchial asthma, Crohn's disease; multiple sclerosis, treatment of Albright Hereditary Osteoedystrophy, and other diseases, disorders and conditions of the like.

These methods of treatment will be discussed more fully, below.

Disease and Disorders

Diseases and disorders that are characterized by increased (relative tola subject not suffering from the disease or disorder) levels or biological activity may be treated with Therapeutics that antagonize (i.e., reduce or inhibit) activity. Therapeutics that antagonize activity may be administered in a therapeutic or prophylactic manner. Therapeutics that may be utilized include, but are not limited to: (i) an aforementioned peptide, or analogs, derivatives, fragments or homologs thereof, (ii) antibodies to an aforementioned peptide; (iii) nucleic acids encoding an aforementioned peptide; (iv) administration of antisense nucleic acid and nucleic acids that are "dysfunctional" (i.e., due to a heterologous insertion within the coding sequences of coding sequences to an aforementioned peptide) that are utilized to "knockout" endogenous function of an aforementioned peptide by homologous recombination (see, e.g., Capecchi, 1989. *Science* 244: 1288–1292); or (v) modulators (i.e., inhibitors, agonists and antagonists, including additional peptide mimetic of the invention or antibodies specific to a peptide of the invention) that alter the interaction between an aforementioned peptide and its binding partner.

Diseases and disorders that are characterized by decreased (relative to a subject not suffering from the disease or disorder) levels or biological activity may be treated with Therapeutics that increase (i.e., are agonists to) activity. Therapeutics that upregulate activity may be administered in a therapeutic or prophylactic manner. Therapeutics that may be utilized include, but are not limited to, an aforementioned peptide, or analogs, derivatives, fragments or homologs thereof, or an agonist that increases bioavailability.

Increased or decreased levels can be readily detected by quantifying peptide and/or RNA, by obtaining a patient tissue sample (e.g., from biopsy tissue) and assaying it in vitro for RNA or peptide levels, structure and/or activity of the expressed peptides (or mRNAs of an aforementioned peptide). Methods that arc well-known within the art include, but are not limited to, immunoassays (e.g., by Western blot analysis, immunoprecipitation followed by sodium dodecyl sulfate (SDS) polyacrylamide gel electrophoresis, immunocytochemistry, etc.) and/or hybridization assays to detect expression of mRNAs (e.g., Northern assays, dot blots, in situ hybridization, and the like).

Prophylactic Methods

In one aspect, the invention provides a method for preventing, in a subject, a disease or condition associated with an aberrant NOVX expression or activity, by administering to the subject an agent that modulates NOVX expression or at least one NOVX activity. Subjects at risk for a disease that is caused or contributed to by aberrant NOVX expression or activity can be identified by, for example, any or a combination of diagnostic or prognostic assays as described herein. Administration of a prophylactic agent can occur prior to the manifestation of symptoms characteristic of the NOVX aberrancy, such that a disease or disorder is prevented or, alternatively, delayed in its progression. Depending upon the type of NOVX aberrancy, for example, an NOVX agonist or NOVX antagonist agent can be used for treating the subject. The appropriate agent can be determined based on screening assays described herein. The prophylactic methods of the invention are further discussed in the following subsections.

Therapeutic Methods

Another aspect of the invention pertains to methods of modulating NOVX expression or activity for therapeutic purposes. The modulatory method of the invention involves contacting a cell with an agent that modulates one or more of the activities of NOVX protein activity associated with the cell. An agent that modulates NOVX protein activity can be an agent as described herein, such as a nucleic acid or a protein, a naturally-occurring cognate ligand of an NOVX protein, a peptide, an NOVX peptidomimetic, or other small molecule. In one embodiment, the agent stimulates one or more NOVX protein activity. Examples of such stimulatory agents include active NOVX protein and a nucleic acid molecule encoding NOVX that has been introduced into the cell. In another embodiment, the agent inhibits one or more NOVX protein activity. Examples of such inhibitory agents include antisense NOVX nucleic acid molecules and anti-NOVX antibodies. These modulatory methods can be performed in vitro (e.g., by culturing the cell with the agent) or, alternatively, in vivo (e.g., by administering the agent to a subject). As such, the invention provides methods of treating an individual afflicted with a disease or disorder characterized by aberrant expression or activity of an NOVX protein or nucleic acid molecule. In one embodiment, the method involves administering an agent (e.g., an agent identified by a screening assay described herein), or combination of agents that modulates (e.g., up-regulates or down-regulates) NOVX expression or activity. In another embodiment, the method involves administering an NOVX protein or nucleic acid molecule as therapy to compensate for reduced or aberrant NOVX expression or activity.

Stimulation of NOVX activity is desirable in situations in which NOVX is abnormally downregulated and/or in which increased NOVX activity is likely to have a beneficial effect. One example of such a situation is where a subject has a disorder characterized by aberrant cell proliferation and/or differentiation (e.g., cancer or immune associated disorders). Another example of such a situation is where the subject has a gestational disease (e.g., preclampsia).

Determination of the Biological Effect of the Therapeutic

In various embodiments of the invention, suitable in vitro or in vivo assays are performed to determine the effect of a specific Therapeutic and whether its administration is indicated for treatment of the affected tissue.

In various specific embodiments, in vitro assays may be performed with representative cells of the type(s) involved in the patient's disorder, to determine if a given Therapeutic exerts the desired effect upon the cell type(s). Compounds for use in therapy may be tested in suitable animal model systems including, but not limited to rats, mice, chicken, cows, monkeys, rabbits, and the like, prior to testing in human subjects. Similarly, for in vivo testing, any of the animal model system known in the art may be used prior to administration to human subjects.

Prophylactic and Therapeutic Uses of the Compositions of the Invention

The NOVX nucleic acids and proteins of the invention are useful in potential prophylactic and therapeutic applications implicated in a variety of disorders including, but not limited to: metabolic disorders, diabetes, obesity, infectious disease, anorexia, cancer-associated cancer, neurodegenerative disorders, Alzheimer's Disease, Parkinson's Disorder, immune disorders, hematopoietic disorders, and the various dyslipidemias, metabolic disturbances associated with obesity, the metabolic syndrome X and wasting disorders associated with chronic diseases and various cancers.

As an example, a cDNA encoding the NOVX protein of the invention may be useful in gene therapy, and the protein may be useful when administered to a subject in need thereof. By way of non-limiting example, the compositions of the invention will have efficacy for treatment of patients suffering from: metabolic disorders, diabetes, obesity, infectious disease, anorexia, cancer-associated cachexia, cancer, neurodegenerative disorders, Alzheimer's Disease, Parkinson's Disorder, immune disorders, hematopoietic disorders, and the various dyslipidemias.

Both the novel nucleic acid encoding the NOVX protein, and the NOVX protein of the invention, or fragments thereof, may also be useful in diagnostic applications, wherein the presence or amount of the nucleic acid or the protein are to be assessed. A further use could be as an anti-bacterial molecule (i.e., some peptides have been found to possess anti-bacterial properties). These materials are further useful in the generation of antibodies, which immunospecifically-bind to the novel substances of the invention for use in therapeutic or diagnostic methods.

The invention will be further described in the following examples, which do not limit the scope of the invention described in the claims.

EXAMPLES

Example 1

Identification of NOVX Clones

The novel NOVX target sequences identified in the present invention were subjected to the exon linking process to confirm the sequence. PCR primers were designed by starting at the most upstream sequence available, for the forward primer, and at the most downstream sequence available for the reverse primer. Table 13A shows the sequences of the PCR primers used for obtaining different clones. In each case, the sequence was examined, walking inward from the respective termini toward the coding sequence, until a suitable sequence that is either unique or highly selective was encountered, or, in the case of the reverse primer, until the stop codon was reached. Such primers were designed based on in silico predictions for the full length cDNA, part (one or more exons) of the DNA or protein sequence of the target sequence, or by translated homology of the predicted exons to closely related human sequences from other species. These primers were then employed in PCR amplification based on the following pool of human cDNAs: adrenal gland, bone marrow, brain—amygdala, brain—cerebellum, brain—hippocampus, brain—substantia nigra, brain—thalamus, brain—whole, fetal brain, fetal kidney, fetal liver, fetal lung, heart, kidney, lymphoma—Raji, mammary gland, pancreas, pituitary gland, placenta, prostate, salivary gland, skeletal muscle, small intestine, spinal cord, spleen, stomach, testis, thyroid, trachea, uterus. Usually the resulting amplicons were gel purified, cloned and sequenced to high redundancy. The PCR product derived from exon linking was cloned into the pCR2.1 vector from Invitrogen. The resulting bacterial clone has an insert covering the entire open reading frame cloned into the pCR2.1 vector. Table 13B shows a list of these bacterial clones. The resulting sequences from all clones were assembled with themselves, with other fragments in CuraGen Corporation's database and with public ESTs. Fragments and ESTs were included as components for an assembly when the extent of their identity with another component of the assembly was at least 95% over 50 bp. In addition, sequence traces were evaluated manually and edited for corrections if appropriate. These procedures provide the sequence reported herein.

TABLE 13A

PCR Primers for Exon Linking

| NOVX Clone | Primer 1 (5'-3') | SEQ ID NO | Primer 2 (5'-3') | SEQ ID NO |
|---|---|---|---|---|
| NOV1a | AGACTGGGGCCAGGGAGACAG | 119 | CAGAGGCCAAACATCCCCATCAG | 120 |
| NOV1c | GAGACAGCCCTGGGGGAGA | 121 | ACCTGCCTCCTGCCAGTCC | 122 |
| NOV6 | CATGTCCTCGACCGAGAGCGC | 123 | AGGTGGGGGGCTGCTTACTGCTT | 124 |
| NOV9a | GTCATGAAGGGGTTGCTG | 125 | GGTCAGCCCAGCCCCTCTG | 126 |
| NOV10 | CGGCTGCTGGCATGGGTG | 127 | CTCCTGCTCTGTTTCCCCCTTCAT | 128 |
| NOV11a | GCCATGGTGCTGCTGCTGCT | 129 | GGCTCAGTCGGGGTAGATGATAAAGC | 130 |
| NOV11b | CGGGCGCGGCCGTCGGAGT | 131 | CGGGGCCGGCTCAGTCGGGGTAGATGAT | 132 |

Physical clone: Exons were predicted by homology and the intron/exon boundaries were determined using standard genetic rules. Exons were further selected and refined by means of similarity determination using multiple BLAST (for example, tBlastN, BlastX, and BlastN) searches, and, in some instances, GeneScan and Grail. Expressed sequences from both public and proprietary databases were also added when available to further define and complete the gene sequence. The DNA sequence was then manually corrected for apparent inconsistencies thereby obtaining the sequences encoding the full-length protein.

Table 13A. Physical Clones for PCR Products

TABLE 13B

Physical Clones for PCR products

| NOVX Clone | Clone |
|---|---|
| NOV1a | Proprietary clones: 145150175, 145150395, 145150392, 145145203, 145150171, 145150168, 137114011 |
| NOV2a | Physical clones: 107029754, AC078825, AC083812 |
| NOV3 | Physical clones: 134899552, AC005230 |
| NOV4 | Genomic clnoe: ba568g11 |
| NOV5 | Genomic clone: AC008774 |
| NOV6 | Bacterial clone: 111865::GMAC073364_A.698299.A2 |
| NOV7 | Physical clone: 106973211, AC015855.4 |
| NOV8 | Physical clone: 88091010, AL109932.3, AL360269.3, AL356323.6 |
| NOV10 | Proprietary clones: 140488852, 133419352, 141920635 |
| NOV11a | Genomic clone: AC026125 |
| NOV12 | Genomic clone: AC011199 |

Example 2

Quantitative Expression Analysis of Clones in Various Tissues and Cells

The quantitative expression of various clones was assessed using microtiter plates containing RNA samples from a variety of normal and pathology-derived cells, cell lines and tissues using real time quantitative PCR (RTQ PCR). RTQ PCR was performed on an Applied Biosystems ABI PRISM® 7700 or an ABI PRISM® 7900 HT Sequence Detection System. Various collections of samples are assembled on the plates, and referred to as Panel 1 (containing normal tissues and cancer cell lines), Panel 2 (containing samples derived from tissues from normal and cancer sources), Panel 3 (containing cancer cell lines), Panel 4 (containing cells and cell lines from normal tissues and cells related to inflammatory conditions), Panel 5D/5I (containing human tissues and cell lines with an emphasis on metabolic diseases), AI_comprehensive_panel (containing normal tissue and samples from autoinflammatory diseases), Panel CNSD.01 (containing samples from normal and diseased brains) and CNS_neurodegeneration_panel (containing samples from normal and Alzheimer's diseased brains).

RNA integrity from all samples is controlled for quality by visual assessment of agarose gel electropherograms using 28S and 18S ribosomal RNA staining intensity ratio as a guide (2:1 to 2.5:1 28s: 18s) and the absence of low molecular weight RNAs that would be indicative of degradation products. Samples are controlled against genomic DNA contamination by RTQ PCR reactions run in the absence of reverse transcriptase using probe and primer sets designed to amplify across the span of a single exon.

First, the RNA samples were normalized to reference nucleic acids such as constitutively expressed genes (for example, β-actin and GAPDH). Normalized RNA (5 ul) was converted to cDNA and analyzed by RTQ-PCR using One Step RT-PCR Master Mix Reagents (Applied Biosystems; Catalog No. 4309169) and gene-specific primers according to the manufacturer's instructions.

In other cases, non-normalized RNA samples were converted to single strand cDNA (sscDNA) using Superscript II (Invitrogen Corporation; Catalog No. 18064-147) and random hexamers according to the manufacturer's instructions. Reactions containing up to 10 µg of total RNA were performed in a volume of 20 µl and incubated for 60 minutes at 42° C. This reaction can be scaled up to 50 µg of total RNA in a final volume of 100 µl. sscDNA samples are then normalized to reference nucleic acids as described previously, using 1×TaqMan® Universal Master mix (Applied Biosystems; catalog No. 4324020), following the manufacturer's instructions.

Probes and primers were designed for each assay according to Applied Biosystems Primer Express Software package (version I for Apple Computer's Macintosh Power PC) or a similar algorithm using the target sequence as input. Default settings were used for reaction conditions and the following parameters were set before selecting primers: primer concentration=250 nM, primer melting temperature (Tm) range=58°–60° C., primer optimal Tm=59° C., maximum primer difference=2° C., probe does not have 5'G, probe Tm must be 10° C. greater than primer Tm, amplicon size 75 bp to 100 bp. The probes and primers selected (see below) were synthesized by Synthegen (Houston, Tex., USA). Probes were double purified by HPLC to remove uncoupled dye and evaluated by mass spectroscopy to verify coupling of reporter and quencher dyes to the 5' and 3' ends of the probe, respectively. Their final concentrations were: forward and reverse primers, 900 nM each, and probe, 200 nM.

PCR conditions: When working with RNA samples, normalized RNA from each tissue and each cell line was spotted in each well of either a 96 well or a 384-well PCR plate (Applied Biosystems). PCR cocktails included either a single gene specific probe and primers set, or two multiplexed probe and primers sets (a set specific for the target clone and another gene-specific set multiplexed with the target probe). PCR reactions were set up using TaqMan® One-Step RT-PCR Master Mix (Applied Biosystems, Catalog No. 4313803) following manufacturer's instructions. Reverse transcription was performed at 48° C. for 30 minutes followed by amplification/PCR cycles as follows: 95° C. 10 min, then 40 cycles of 95° C. for 15 seconds, 60° C. for 1 minute. Results were recorded as CT values (cycle at which a given sample crosses a threshold level of fluorescence) using a log scale, with the difference in RNA concentration between a given sample and the sample with the lowest CT value being represented as 2 to the power of delta CT. The percent relative expression is then obtained by taking the reciprocal of this RNA difference and multiplying by 100.

When working with sscDNA samples, normalized sscDNA was used as described previously for RNA samples. PCR reactions containing one or two sets of probe and primers were set up as described previously, using 1×TaqMan® Universal Master mix (Applied Biosystems; catalog No. 4324020), following the manufacturer's instructions. PCR amplification was performed as follows: 95° C. 10 min, then 40 cycles of 95° C. for 15 seconds, 60° C. for 1 minute. Results were analyzed and processed as described previously.

Panels 1, 1.1, 1.2, and 1.3D

The plates for Panels 1, 1.1, 1.2 and 10.3D include 2 control wells (genomic DNA control and chemistry control) and 94 wells containing cDNA from various samples. The samples in these panels are broken into 2 classes: samples derived from cultured cell lines and samples derived from primary normal tissues. The cell lines are derived from cancers of the following types: lung cancer, breast cancer, melanoma, colon cancer, prostate cancer, CNS cancer, squamous cell carcinoma, ovarian cancer, liver cancer, renal cancer, gastric cancer and pancreatic cancer. Cell lines used in these panels are widely available through the American Type Culture Collection (ATCC), a repository for cultured cell lines, and were cultured using the conditions recommended by the ATCC. The normal tissues found on these panels are comprised of samples derived from all major organ systems from single adult individuals or fetuses. These samples are derived from the following organs: adult skeletal muscle, fetal skeletal muscle, adult heart, fetal heart, adult kidney, fetal kidney, adult liver, fetal liver, adult lung, fetal lung, various regions of the brain, the spleen, bone marrow, lymph node, pancreas, salivary gland, pituitary gland, adrenal gland, spinal cord, thymus, stomach, small intestine, colon, bladder, trachea, breast, ovary, uterus, placenta, prostate, testis and adipose.

In the results for Panels 1, 1.1, 1.2 and 1.3D, the following abbreviations are used:

ca.=carcinoma,

*=established from metastasis, met=metastasis, s cell var=small cell variant, non-s=non-sm=non-small, squam=squamous, pl. eff=pl effusion=pleural effusion, glio=glioma, astro=astrocytoma, and neuro=neuroblastoma.

General_Screening_Panel_v1.4

The plates for Panel 1.4 include 2 control wells (genomic DNA control and chemistry control) and 94 wells containing cDNA from various samples. The samples in Panel 1.4 are broken into 2 classes: samples derived from cultured cell lines and samples derived from primary normal tissues. The cell lines are derived from cancers of the following types: lung cancer, breast cancer, melanoma, colon cancer, prostate cancer, CNS cancer, squamous cell carcinoma, ovarian cancer, liver cancer, renal cancer, gastric cancer and pancreatic cancer. Cell lines used in Panel 1.4 are widely available through the American Type Culture Collection (ATCC), a repository for cultured cell lines, and were cultured using the conditions recommended by the ATCC. The normal tissues found on Panel 1.4 are comprised of pools of samples derived from all major organ systems from 2 to 5 different adult individuals or fetuses. These samples are derived from the following organs: adult skeletal muscle, fetal skeletal muscle, adult heart, fetal heart, adult kidney, fetal kidney, adult liver, fetal liver, adult lung, fetal lung, various regions of the brain, the spleen, bone marrow, lymph node, pancreas, salivary gland, pituitary gland, adrenal gland, spinal cord, thymus, stomach, small intestine, colon, bladder, trachea, breast, ovary, uterus, placenta, prostate, testis and adipose. Abbreviations are as described for Panels 1, 1.1, 1.2, and 1.3D.

Panels 2D and 2.2

The plates for Panels 2D and 2.2 generally include 2 control wells and 94 test samples composed of RNA or cDNA isolated from human tissue procured by surgeons working in close cooperation with the National Cancer Institute's Cooperative Human Tissue Network (CHTN) or the National Disease Research Initiative (NDRI). The tissues are derived from human malignancies and in cases where indicated many malignant tissues have "matched margins" obtained from noncancerous tissue just adjacent to the tumor. These are termed normal adjacent tissues and are denoted "NAT" in the results below. The tumor tissue and the "matched margins" are evaluated by two independent pathologists (the surgical pathologists and again by a pathologist at NDRI or CHTN). This analysis provides a gross histopathological assessment of tumor differentiation grade. Moreover, most samples include the original surgical pathology report that provides information regarding the clinical stage of the patient. These matched margins are taken from the tissue surrounding (i.e. immediately proximal) to the zone of surgery (designated "NAT", for normal adjacent tissue, in Table RR). In addition, RNA and cDNA samples were obtained from various human tissues derived from autopsies performed on elderly people or sudden death victims (accidents, etc.). These tissues were ascertained to be free of disease and were purchased from various commercial sources such as Clontech (Palo Alto, Calif.), Research Genetics, and Invitrogen.

Panel 3D

The plates of Panel 3D are comprised of 94 cDNA samples and two control samples. Specifically, 92 of these samples are derived from cultured human cancer cell lines, 2 samples of human primary cerebellar tissue and 2 controls. The human cell lines are generally obtained from ATCC (American Type Culture Collection), NCI or the German tumor cell bank and fall into the following tissue groups: Squamous cell carcinoma of the tongue, breast cancer, prostate cancer, melanoma, epidermoid carcinoma, sarcomas, bladder carcinomas, pancreatic cancers, kidney cancers, leukemias/lymphomas, ovarian/uterine/cervical, gastric, colon, lung and CNS cancer cell lines. In addition, there are two independent samples of cerebellum. These cells are all cultured under standard recommended conditions and RNA extracted using the standard procedures. The cell lines in panel 3D and 1.3D are of the most common cell lines used in the scientific literature.

Panels 4D, 4R, and 4.1D

Panel 4 includes samples on a 96 well plate (2 control wells, 94 test samples) composed of RNA (Panel 4R) or cDNA (Panels 4D/4.1D) isolated from various human cell lines or tissues related to inflammatory conditions. Total RNA from control normal tissues such as colon and lung (Stratagene, La Jolla, Calif.) and thymus and kidney (Clontech) was employed. Total RNA from liver tissue from cirrhosis patients and kidney from lupus patients was obtained from BioChain (Biochain Institute, Inc., Hayward, Calif.). Intestinal tissue for RNA preparation from patients diagnosed as having Crohn's disease and ulcerative colitis was obtained from the National Disease Research Interchange (NDRI) (Philadelphia, Pa.).

Astrocytes, lung fibroblasts, dermal fibroblasts, coronary artery smooth muscle cells, small airway epithelium, bronchial epithelium, microvascular dermal endothelial cells, microvascular lung endothelial cells, human pulmonary aortic endothelial cells, human umbilical vein endothelial cells were all purchased from Clonetics (Walkersville, Md.) and grown in the media supplied for these cell types by Clonetics. These primary cell types were activated with various cytokines or combinations of cytokines for 6 and/or 12–14 hours, as indicated. The following cytokines were used; IL-1 beta at approximately 1–5 ng/ml, TNF alpha at approximately 5–10 ng/ml, IFN gamma at approximately 20–50 ng/ml, IL-4 at approximately 5–10 ng/ml, IL-9 at approximately 5–10 ng/ml, IL-13 at approximately 5–10 ng/ml. Endothelial cells were sometimes starved for various times by culture in the basal media from Clonetics with 0.1% serum.

Mononuclear cells were prepared from blood of employees at CuraGen Corporation, using Ficoll. LAK cells were prepared from these cells by culture in DMEM 5% FCS (Hyclone), 100 µM non essential amino acids (Gibco/Life Technologies, Rockville, Md.), 1 mM sodium pyruvate (Gibco), mercaptoethanol $5.5 \times 10^{-5}$M (Gibco), and 10 mM Hepes (Gibco) and Interleukin 2 for 4–6 days. Cells were then either activated with 10–20 ng/ml PMA and 1–2 µg/ml ionomycin, IL-12 at 5–10 ng/ml, IFN gamma at 20–50 ng/ml and IL-18 at 5–10 ng/ml for 6 hours. In some cases, mononuclear cells were cultured for 4–5 days in DMEM 5% FCS (Hyclone), 100 µM non essential amino acids (Gibco), 1 mM sodium pyruvate (Gibco), mercaptoethanol $5.5 \times 10^{-5}$M (Gibco), and 10 mM Hepes (Gibco) with PHA (phytohemagglutinin) or PWM (pokeweed mitogen) at approximately 5 µg/ml. Samples were taken at 24, 48 and 72 hours for RNA preparation. MLR (mixed lymphocyte reaction) samples were obtained by taking blood from two donors, isolating the mononuclear cells using Ficoll and mixing the isolated mononuclear cells 1:1 at a final concentration of approximately $2 \times 10^6$ cells/ml in DMEM 5% FCS (Hyclone), 100 µM non essential amino acids (Gibco), 1 mM sodium pyruvate (Gibco), mercaptoethanol ($5.5 \times 10^{-5}$M) (Gibco), and 10 nmM Hepes (Gibco). The MLR was cultured and samples taken at various time points ranging from 1–7 days for RNA preparation.

Monocytes were isolated from mononuclear cells using CD14 Miltenyi Beads, +ve VS selection columns and a Vario Magnet according to the manufacturer's instructions. Monocytes were differentiated into dendritic cells by culture in DMEM 5% fetal calf serum (FCS) (Hyclone, Logan, Utah), 100 µM non essential amino acids (Gibco), 1 mM sodium pyruvate (Gibco), mercaptoethanol $5.5 \times 10^{-5}$M (Gibco), and 10 mM Hepes (Gibco), 50 ng/ml GMCSF and 5 ng/ml IL-4 for 5–7 days. Macrophages were prepared by culture of monocytes for 5–7 days in DMEM 5% FCS (Hyclone), 100 µM non essential amino acids (Gibco), 1 mM sodium pyruvate (Gibco), mercaptoethanol $5.5 \times 10^{-5}$M (Gibco), 10 mM Hepes (Gibco) and 10% AB Human Serum or MCSF at approximately 50 ng/ml. Monocytes, macrophages and dendritic cells were stimulated for 6 and 12–14 hours with lipopolysaccharide (LPS) at 100 ng/ml. Dendritic cells were also stimulated with anti-CD40 monoclonal antibody (Pharmingen) at 10 µg/ml for 6 and 12–14 hours.

CD4 lymphocytes, CD8 lymphocytes and NK cells were also isolated from mononuclear cells using CD4, CD8 and CD56 Miltenyi beads, positive VS selection columns and a Vario Magnet according to the manufacturer's instructions. CD45RA and CD45RO CD4 lymphocytes were isolated by depleting mononuclear cells of CD8, CD56, CD14 and CD19 cells using CD8, CD56, CD14 and CD19 Miltenyi beads and positive selection. CD45RO beads were then used to isolate the CD45RO CD4 lymphocytes with the remaining cells being CD45RA CD4 lymphocytes. CD45RA CD4, CD45RO CD4 and CD8 lymphocytes were placed in DMEM 5% FCS (Hyclone), 100 µM non essential amino acids (Gibco), 1 mM sodium pyruvate (Gibco), mercaptoethanol $5.5 \times 10^{-5}$M (Gibco), and 10 mM Hepes (Gibco) and plated at $10^6$ cells/ml onto Falcon 6 well tissue culture plates that had been coated overnight with 0.5 µg/ml anti-CD28 (Pharmingen) and 3 ug/ml anti-CD3 (OKT3, ATCC) in PBS. After 6 and 24 hours, the cells were harvested for RNA preparation. To prepare chronically activated CD8 lymphocytes, we activated the isolated CD8 lymphocytes for 4 days on anti-CD28 and anti-CD3 coated plates and then harvested the cells and expanded them in DMEM 5% FCS (Hyclone), 100 µM non essential amino acids (Gibco), 1 mM sodium pyruvate (Gibco), mercaptoethanol $5.5 \times 10^{-5}$M (Gibco), and 10 nmM Hepes (Gibco) and IL-2. The expanded CD8 cells were then activated again with plate bound anti-CD3 and anti-CD28 for 4 days and expanded as before. RNA was isolated 6 and 24 hours after the second activation and after 4 days of the second expansion culture. The isolated NK cells were cultured in DMEM 5% FCS (Hyclone), 100 μM non essential amino acids (Gibco), 1 mM sodium pyruvate (Gibco), mercaptoethanol $5.5 \times 10^{-5}$ M (Gibco), and 10 mM Hepes (Gibco) and IL-2 for 4–6 days before RNA was prepared.

To obtain B cells, tonsils were procured from NDRI. The tonsil was cut up with sterile dissecting scissors and then passed through a sieve. Tonsil cells were then spun down and resupended at $10^6$ cells/ml in DMEM 5% FCS (Hyclone), 100 μM non essential amino acids (Gibco), 1 mM sodium pyruvate (Gibco), mercaptoethanol $5.5 \times 10^{-5}$ M (Gibco), and 10 mM Hepes (Gibco). To activate the cells, we used PWM at 5 μg/ml or anti-CD40 (Pharmingen) at approximately 10 μg/ml and IL-4 at 5–10 ng/ml. Cells were harvested for RNA preparation at 24,48 and 72 hours.

To prepare the primary and secondary Th1/Th2 and Tr1 cells, six-well Falcon plates were coated overnight with 10 μg/ml anti-CD28 (Pharmingen) and 2 μg/ml OKT3 (ATCC), and then washed twice with PBS. Umbilical cord blood CD4 lymphocytes (Poietic Systems, German Town, Md.) were cultured at $10^5$–$10^6$ cells/ml in DMEM 5% FCS (Hyclone), 100 μM non essential amino acids (Gibco), 1 mM sodium pyruvate (Gibco), mercaptoethanol $5.5 \times 10^{-5}$ M (Gibco), 10 mM Hepes (Gibco) and IL-2 (4 ng/ml). IL-12 (5 ng/ml) and anti-IL4 (1 μg/ml) were used to direct to Th1, while IL-4 (5 ng/ml) and anti-IFN gamma (1 μg/ml) were used to direct to Th2 and IL-10 at 5 ng/ml was used to direct to Tr1. After 4–5 days, the activated Th1, Th2 and Tr1 lymphocytes were washed once in DMEM and expanded for 4–7 days in DMEM 5% FCS (Hyclone), 100 μM non essential amino acids (Gibco), 1 mM sodium pyruvate (Gibco), mercapto-ethanol $5.5 \times 10^{-5}$ M (Gibco), 10 mM Hepes (Gibco) and IL-2 (1 ng/ml). Following this, the activated Th1, Th2 and Tr1 lymphocytes were re-stimulated for 5 days with anti-CD28/ OKT3 and cytokines as described above, but with the addition of anti-CD95L (1 μg/ml) to prevent apoptosis. After 4–5 days, the Th1, Th2 and Tr1 lymphocytes were washed and then expanded again with IL-2 for 4–7 days. Activated Th1 and Th2 lymphocytes were maintained in this way for a maximum of three cycles. RNA was prepared from primary and secondary Th1, Th2 and Tr1 after 6 and 24 hours following the second and third activations with plate bound anti-CD3 and anti-CD28 mAbs and 4 days into the second and third expansion cultures in Interleukin 2.

The following leukocyte cells lines were obtained from the ATCC: Ramos, EOL-1, KU-812. EOL cells were further differentiated by culture in 0.1 mM dbcAMP at $5 \times 10^5$ cells/ml for 8 days, changing the media every 3 days and adjusting the cell concentration to $5 \times 10^5$ cells/ml. For the culture of these cells, we used DMEM or RPMI (as recommended by the ATCC), with the addition of 5% FCS (Hyclone), 100 μM non essential amino acids (Gibco), 1 mM sodium pyruvate (Gibco), mercaptoethanol $5.5 \times 10^{-5}$ M (Gibco), 10 mM Hepes (Gibco). RNA was either prepared from resting cells or cells activated with PMA at 10 ng/ml and ionomycin at 1 μg/ml for 6 and 14 hours. Keratinocyte line CCD106 and an airway epithelial tumor line NCI-H292 were also obtained from the ATCC. Both were cultured in DMEM 5% FCS (Hyclone), 100 μM non essential amino acids (Gibco), 1 mM sodium pyruvate (Gibco), mercapto-ethanol $5.5 \times 10^{-5}$ M (Gibco), and 10 mM Hepes (Gibco). CCD1106 cells were activated for 6 and 14 hours with approximately 5 ng/ml TNF alpha and 1 ng/ml IL-1 beta, while NCI-H292 cells were activated for 6 and 14 hours with the following cytokines: 5 ng/ml IL-4, 5 ng/ml IL-9, 5 ng/ml IL-13 and 25 ng/ml IFN gamma.

For these cell lines and blood cells, RNA was prepared by lysing approximately $10^7$ cells/ml using Trizol (Gibco BRL). Briefly, 1/10 volume of bromochloropropane (Molecular Research Corporation) was added to the RNA sample, vortexed and after 10 minutes at room temperature, the tubes were spun at 14,000 rpm in a Sorvall SS34 rotor. The aqueous phase was removed and placed in a 15 ml Falcon Tube. An equal volume of isopropanol was added and left at −20° C. overnight. The precipitated RNA was spun down at 9,000 rpm for 15 min in a Sorvall SS34 rotor and washed in 70% ethanol. The pellet was redissolved in 300 μl of RNAse-free water and 35 μl buffer (Promega) 5 μl DTT, 7 μl RNAsin and 8 μl DNAse were added. The tube was incubated at 37° C. for 30 minutes to remove contaminating genomic DNA, extracted once with phenol chloroform and re-precipitated with 1/10 volume of 3M sodium acetate and 2 volumes of 100% ethanol. The RNA was spun down and placed in RNAse free water. RNA was stored at −80° C.

AI_Comprehensive Panel_v1.0

The plates for AI_comprehensive panel_v1.0 include two control wells and 89 test samples comprised of cDNA isolated from surgical and postmortem human tissues obtained from the Backus Hospital and Clinomics (Frederick, Md.). Total RNA was extracted from tissue samples from the Backus Hospital in the Facility at CuraGen. Total RNA from other tissues was obtained from Clinomics.

Joint tissues including synovial fluid, synovium, bone and cartilage were obtained from patients undergoing total knee or hip replacement surgery at the Backus Hospital. Tissue samples were immediately snap frozen in liquid nitrogen to ensure that isolated RNA was of optimal quality and not degraded. Additional samples of osteoarthritis and rheumatoid arthritis joint tissues were obtained from Clinomics. Normal control tissues were supplied by Clinomics and were obtained during autopsy of trauma victims.

Surgical specimens of psoriatic tissues and adjacent matched tissues were provided as total RNA by Clinomics. Two male and two female patients were selected between the ages of 25 and 47. None of the patients were taking prescription drugs at the time samples were isolated.

Surgical specimens of diseased colon from patients with ulcerative colitis and Crohns disease and adjacent matched tissues were obtained from Clinomics. Bowel tissue from three female and three male Crohn's patients between the ages of 41–69 were used. Two patients were not on prescription medication while the others were taking dexamethasone, phenobarbital, or tylenol. Ulcerative colitis tissue was from three male and four female patients. Four of the patients were taking lebvid and two were on phenobarbital.

Total RNA from post mortem lung tissue from trauma victims with no disease or with emphysema, asthma or COPD was purchased from Clinomics. Emphysema patients ranged in age from 40–70 and all were smokers, this age range was chosen to focus on patients with cigarette-linked emphysema and to avoid those patients with alpha-i anti-trypsin deficiencies. Asthma patients ranged in age from 36–75, and excluded smokers to prevent those patients that could also have COPD. COPD patients ranged in age from 35–80 and included both smokers and non-smokers. Most patients were taking corticosteroids, and bronchodilators.

In the labels employed to identify tissues in the AI_comprehensive panel_v1.0 panel, the following abbreviations are used:

AI=Autoimmunity
Syn=Synovial
Normal=No apparent disease
Rep22/Rep20=individual patients
RA=Rheumatoid arthritis
Backus=From Backus Hospital
OA=Osteoarthritis
(SS) (BA) (MF)=Individual patients
Adj=Adjacent tissue
Match control=adjacent tissues
-M=Male
-F=Female
COPD=Chronic obstructive pulmonary disease Panels 5D and 5I The plates for Panel 5D and 5I include two control wells and a variety of cDNAs isolated from human tissues and cell lines with an emphasis on metabolic diseases. Metabolic tissues were obtained from patients enrolled in the Gestational Diabetes study. Cells were obtained during different stages in the differentiation of adipocytes from human mesenchymal stem cells. Human pancreatic islets were also obtained.

In the Gestational Diabetes study subjects are young (18–40 years), otherwise healthy women with and without gestational diabetes undergoing routine (elective) Caesarean section. After delivery of the infant, when the surgical incisions were being repaired/closed, the obstetrician removed a small sample.

Patient 2: Diabetic Hispanic, overweight, not on insulin
Patient 7–9: Nondiabetic Caucasian and obese (BMI>30)
Patient 10: Diabetic Hispanic, overweight, on insulin
Patient 11: Nondiabetic African American and overweight
Patient 12: Diabetic Hispanic on insulin Adipocyte differentiation was induced in donor progenitor cells obtained from Osirus (a division of Clonetics/BioWhittaker) in triplicate, except for Donor 3U which had only two replicates. Scientists at Clonetics isolated, grew and differentiated human mesenchymal stem cells (HuMSCs) for CuraGen based on the published protocol found in Mark F. Pittenger, et al., Multilineage Potential of Adult Human Mesenchymal Stem Cells Science Apr. 2, 1999: 143–147. Clonetics provided Trizol lysates or frozen pellets suitable for mRNA isolation and ds cDNA production. A general description of each donor is as follows:

Donor 2 and 3 U: Mesenchymal Stem cells, Undifferentiated Adipose
Donor 2 and 3 AM: Adipose, AdiposeMidway Differentiated
Donor 2 and 3 AD: Adipose, Adipose Differentiated Human cell lines were generally obtained from ATCC (American Type Culture Collection), NCI or the German tumor cell bank and fall into the following tissue groups: kidney proximal convoluted tubule, uterine smooth muscle cells, small intestine, liver HepG2 cancer cells, heart primary stromal cells, and adrenal cortical adenoma cells. These cells are all cultured under standard recommended conditions and RNA extracted using the standard procedures. All samples were processed at CuraGen to produce single stranded cDNA.

Panel 5I contains all samples previously described with the addition of pancreatic islets from a 58 year old female patient obtained from the Diabetes Research Institute at the University of Miami School of Medicine. Islet tissue was processed to total RNA at an outside source and delivered to CuraGen for addition to panel 5I.

In the labels employed to identify tissues in the 5D and 5I panels, the following abbreviations are used:

GO Adipose=Greater Omentum Adipose
SK=Skeletal Muscle
UT=Uterus
PL=Placenta
AD=Adipose Differentiated
AM=Adipose Midway Differentiated
U=Undifferentiated Stem Cells Panel CNSD.01

The plates for Panel CNSD.01 include two control wells and 94 test samples comprised of cDNA isolated from postmortem human brain tissue obtained from the Harvard Brain Tissue Resource Center. Brains are removed from calvaria of donors between 4 and 24 hours after death, sectioned by neuroanatomists, and frozen at −80° C. in liquid nitrogen vapor. All brains are sectioned and examined by neuropathologists to confirm diagnoses with clear associated neuropathology.

Disease diagnoses are taken from patient records. The panel contains two brains from each of the following diagnoses: Alzheimer's disease, Parkinson's disease, Huntington's disease, Progressive Supemuclear Palsy, Depression, and "Normal controls". Within each of these brains, the following regions are represented: cingulate gyrus, temporal pole, globus palladus, substantia nigra, Brodman Area 4 (primary motor strip), Brodman Area 7 (parietal cortex), Brodman Area 9 (prefrontal cortex), and Brodman area 17 (occipital cortex). Not all brain regions are represented in all cases; e.g., Huntington's disease is characterized in part by neurodegeneration in the globus palladus, thus this region is impossible to obtain from confirmed Huntington's cases. Likewise Parkinson's disease is characterized by degeneration of the substantia nigra making this region more difficult to obtain. Normal control brains were examined for neuropathology and found to be free of any pathology consistent with neurodegeneration.

In the labels employed to identify tissues in the CNS panel, the following abbreviations are used:

PSP=Progressive supranuclear palsy
Sub Nigra=Substantia nigra
Glob Palladus=Globus palladus
Temp Pole=Temporal pole
Cing Gyr=Cingulate gyrus
BA 4=Brodman Area 4

Panel CNS_Neurodegeneration_V1.0

The plates for Panel CNS_Neurodegeneration_V1.0 include two control wells and 47 test samples comprised of cDNA isolated from postmortem human brain tissue obtained from the Harvard Brain Tissue Resource Center (McLean Hospital) and the Human Brain and Spinal Fluid Resource Center (VA Greater Los Angeles Healthcare System). Brains are removed from calvaria of donors between 4 and 24 hours after death, sectioned by neuroanatomists, and frozen at −80° C. in liquid nitrogen vapor. All brains are sectioned and examined by neuropathologists to confirm diagnoses with clear associated neuropathology.

Disease diagnoses are taken from patient records. The panel contains six brains from Alzheimer's disease (AD) patients, and eight brains from "Normal controls" who showed no evidence of dementia prior to death. The eight normal control brains are divided into two categories: Controls with no dementia and no Alzheimer's like pathology (Controls) and controls with no dementia but evidence of severe Alzheimer's like pathology, (specifically senile plaque load rated as level 3 on a scale of 0–3; 0=no evidence of plaques, 3=severe AD senile plaque load). Within each of these brains, the following regions are represented: hippocampus, temporal cortex (Brodman Area 21), parietal cortex (Brodman area 7), and occipital cortex (Brodman area 17). These regions were chosen to encompass all levels of neurodegeneration in AD. The hippocampus is a region of early and severe neuronal loss in AD; the temporal cortex is known to show neurodegeneration in AD after the hippocampus; the parietal cortex shows moderate neuronal death in the late stages of the disease; the occipital cortex is spared in AD and therefore acts as a "control" region within AD patients. Not all brain regions are represented in all cases.

In the labels employed to identify tissues in the CNS_Neurodegeneration_V1.0 panel, the following abbreviations are used:
 AD=Alzheimer's disease brain; patient was demented and showed AD-like pathology upon autopsy
 Control=Control brains; patient not demented, showing no neuropathology
 Control (Path)=Control brains; pateint not demented but showing sever AD-like pathology
 SupTemporal Ctx=Superior Temporal Cortex
 Inf Temporal Ctx=Inferior Temporal Cortex
 NOV1b, NOV1c Expression of NOV1b and NOV1c was assessed using the primer-probe sets Ag1848, Ag2263, Ag2422 and Ag1522, described in Tables 14, 15, 16 and 17. Results of the RTQ-PCR runs are shown in Tables 18, 19, 20, 21, 22, 23 and 24.

TABLE 14

Probe Name Ag1848

| Primers | Sequences | Length | Start Position | SEQ ID NO: |
|---|---|---|---|---|
| Forward | 5'-TGACTTCGACACAGACATCACT-3' | 22 | 1234 | 133 |
| Probe | TET-5'-ACTCATCTGCTGCCCTGACTGGTG-3'-TAMRA | 24 | 1257 | 134 |
| Reverse | 5'-CCTTGCCGTCTTAAAGTTGAC-3' | 21 | 1292 | 135 |

TABLE 15

Probe Name Ag2263

| Primers | Sequences | Length | Start Position | SEQ ID NO: |
|---|---|---|---|---|
| Forward | 5'-TGACTTCGACACAGACATCACT-3' | 22 | 1234 | 136 |
| Probe | TET-5'-ACTCATCTGCTGCCCTGACTGGTG-3'-TAMRA | 24 | 1257 | 137 |
| Reverse | 5'-CCTTGCCGTCTTAAAGTTGAC-3' | 21 | 1292 | 138 |

TABLE 16

Probe Name Ag2422

| Primers | Sequences | Length | Start Position | SEQ ID NO: |
|---|---|---|---|---|
| Forward | 5'-GGCTCCCTGGACACTCTCT-3' | 19 | 2522 | 139 |
| Probe | TET-5'-CTGTCACCACCCAGCTGGGACCTTAT-3'-TAMRA | 26 | 2559 | 140 |
| Reverse | 5'-TGGACAGTGGGATCTTGAAG-3' | 20 | 2587 | 141 |

TABLE 17

Probe Name Ag1522

| Primers | Sequences | Length | Start Position | SEQ ID NO: |
|---|---|---|---|---|
| Forward | 5'-TGACTTCGACACAGACATCACT-3' | 22 | 1234 | 142 |
| Probe | TET-5'-ACTCATCTGCTGCCCTGACTGGTG-3'-TAMRA | 24 | 1257 | 143 |
| Reverse | 5'-CCTTGCCGTCTTAAAGTTGAC-3' | 21 | 1292 | 144 |

TABLE 18

CNS_neurodegeneration_v1.0

| Tissue Name | Rel. Exp. (%) Ag1848, Run 207776125 | Rel. Exp. (%) Ag2263, Run 219933384 | Rel. Exp. (%) Ag2263, Run 224115886 | Rel. Exp. (%) Ag2422, Run 206262709 | Rel. Exp. (%) Ag2422, Run 230512499 |
|---|---|---|---|---|---|
| AD 1 Hippo | 28.3 | 39.0 | 19.3 | 21.3 | 16.6 |
| AD 2 Hippo | 37.9 | 45.1 | 23.5 | 38.7 | 40.1 |
| AD 3 Hippo | 12.0 | 20.6 | 13.9 | 14.9 | 13.0 |
| AD 4 Hippo | 17.7 | 27.2 | 9.0 | 13.3 | 16.4 |
| AD 5 Hippo | 45.4 | 60.3 | 8.1 | 57.8 | 59.0 |
| AD 6 Hippo | 66.9 | 96.6 | 70.2 | 95.9 | 66.0 |
| Control 2 Hippo | 43.2 | 81.2 | 67.8 | 46.0 | 48.3 |
| Control 4 Hippo | 34.2 | 36.6 | 38.7 | 30.4 | 27.5 |
| Control (Path) 3 Hippo | 3.9 | 11.0 | 4.6 | 12.7 | 12.1 |
| AD 1 Temporal Ctx | 47.0 | 79.0 | 69.7 | 40.6 | 27.2 |
| AD 2 Temporal Ctx | 49.3 | 61.6 | 70.7 | 39.8 | 50.7 |
| AD 3 Temporal Ctx | 14.5 | 20.7 | 15.3 | 15.7 | 14.5 |
| AD 4 Temporal Ctx | 41.5 | 53.6 | 31.9 | 36.3 | 39.0 |
| AD 5 Inf Temporal Ctx | 77.9 | 95.9 | 72.2 | 88.9 | 100.0 |
| AD 5 Sup Temporal Ctx | 40.9 | 57.4 | 3.7 | 57.0 | 69.3 |
| AD 6 Inf Temporal Ctx | 84.1 | 99.3 | 100.0 | 74.2 | 83.5 |
| AD 6 Sup Temporal Ctx | 58.2 | 64.6 | 81.8 | 71.7 | 61.1 |
| Control 1 Temporal Ctx | 17.9 | 18.0 | 21.5 | 11.3 | 16.5 |
| Control 2 Temporal Ctx | 45.7 | 39.8 | 66.4 | 44.8 | 55.1 |
| Control 3 Temporal Ctx | 14.7 | 21.8 | 22.7 | 15.6 | 13.5 |
| Control 3 Temporal Ctx | 23.2 | 21.5 | 23.8 | 19.1 | 24.1 |
| Control (Path) 1 Temporal Ctx | 46.0 | 39.8 | 19.3 | 40.3 | 51.1 |
| Control (Path) 2 Temporal Ctx | 24.7 | 40.6 | 23.7 | 21.8 | 24.0 |
| Control (Path) 3 Temporal Ctx | 6.0 | 8.2 | 8.0 | 7.7 | 7.3 |
| Control (Path) 4 Temporal Ctx | 32.1 | 29.5 | 31.0 | 24.0 | 18.6 |
| AD 1 Occipital Ctx | 24.1 | 48.0 | 5.5 | 26.4 | 13.7 |
| AD 2 Occipital Ctx (Missing) | 0.0 | 0.0 | 0.0 | 0.0 | 0.0 |
| AD 3 Occipital Ctx | 19.2 | 25.3 | 20.4 | 18.2 | 18.8 |
| AD 4 Occipital Ctx | 30.1 | 58.2 | 30.6 | 23.3 | 30.8 |
| AD 5 Occipital Ctx | 6.0 | 39.0 | 8.5 | 26.8 | 23.0 |
| AD 5 Occipital Ctx | 43.2 | 51.8 | 53.6 | 50.3 | 47.6 |
| Control 1 Occipital Ctx | 14.6 | 22.2 | 19.1 | 12.8 | 13.4 |
| Control 2 Occipital Ctx | 66.9 | 85.9 | 94.6 | 76.3 | 70.2 |
| Control 3 Occipital Ctx | 17.8 | 37.1 | 8.0 | 17.4 | 13.1 |
| Control 4 Occipital Ctx | 23.3 | 22.2 | 2.7 | 15.7 | 19.1 |
| Control (Path) 1 Occipital Ctx | 100.0 | 100.0 | 63.7 | 100.0 | 90.1 |
| Control (Path) 2 Occipital Ctx | 18.7 | 20.9 | 11.0 | 12.3 | 11.7 |
| Control (Path) 3 Occipital Ctx | 7.9 | 6.1 | 9.4 | 7.1 | 5.8 |
| Control (Path) 4 Occipital Ctx | 24.5 | 21.5 | 11.1 | 14.0 | 13.1 |
| Control 1 Parietal Ctx | 23.2 | 26.8 | 7.4 | 22.2 | 17.6 |
| Control 2 Parietal Ctx | 46.0 | 65.1 | 71.2 | 64.6 | 50.0 |
| Control 3 Parietal Ctx | 26.1 | 27.2 | 16.5 | 17.3 | 19.5 |
| Control (Path) 1 Parietal Ctx | 51.1 | 66.0 | 80.1 | 54.3 | 55.1 |
| Control (Path) 2 Parietal Ctx | 36.3 | 16.5 | 34.2 | 27.9 | 27.9 |
| Control (Path) 3 Parietal Ctx | 6.1 | 10.5 | 1.4 | 5.1 | 4.6 |

TABLE 18-continued

CNS_neurodegeneration_v1.0

| Tissue Name | Rel. Exp. (%) Ag1848, Run 207776125 | Rel. Exp. (%) Ag2263, Run 219933384 | Rel. Exp. (%) Ag2263, Run 224115886 | Rel. Exp. (%) Ag2422, Run 206262709 | Rel. Exp. (%) Ag2422, Run 230512499 |
|---|---|---|---|---|---|
| Control (Path) 4 Parietal Ctx | 46.0 | 52.5 | 10.7 | 36.6 | 12.2 |

TABLE 19

Panel 1.2

| Tissue Name | Rel. Exp. (%) Ag1522, Run 142131145 | Tissue Name | Rel. Exp. (%) Ag1522, Run 142131145 |
|---|---|---|---|
| Endothelial cells | 1.2 | Renal ca. 786-0 | 0.0 |
| Heart (Fetal) | 17.9 | Renal ca. A498 | 0.3 |
| Pancreas | 0.7 | Renal ca. RXF 393 | 0.2 |
| Pancreatic ca. CAPAN 2 | 4.9 | Renal ca. ACHN | 0.1 |
| Adrenal Gland | 7.9 | Renal ca. UO-31 | 0.5 |
| Thyroid | 0.1 | Renal ca. TK-10 | 0.3 |
| Salivary gland | 2.5 | Liver | 2.4 |
| Pituitary gland | 0.1 | Liver (fetal) | 0.5 |
| Brain (fetal) | 0.2 | Liver ca. (hepatoblast) HepG2 | 0.3 |
| Brain (whole) | 3.2 | Lung | 0.3 |
| Brain (amygdala) | 4.4 | Lung (fetal) | 0.4 |
| Brain (cerebellum) | 9.0 | Lung ca. (small cell) LX-1 | 25.3 |
| Brain (hippocampus) | 18.9 | Lung ca. (small cell) NCI-H69 | 43.8 |
| Brain (thalamus) | 15.7 | Lung ca. (s. cell var.) SHP-77 | 0.3 |
| Cerebral Cortex | 35.4 | Lung ca. (large cell)NCI-H460 | 54.7 |
| Spinal cord | 1.6 | Lung ca. (non-sm. cell) A549 | 0.3 |
| glio/astro U87-MG | 72.2 | Lung ca. (non-s. cell) NCI-H23 | 2.4 |
| glio/astro U-118-MG | 3.1 | Lung ca. (non-s. cell) HOP-62 | 1.7 |
| astrocytoma SW1783 | 0.3 | Lung ca. (non-s. cl) NCI-H522 | 9.3 |
| neuro*; met SK-N-AS | 36.3 | Lung ca. (squam.) SW 900 | 1.5 |
| astrocytoma SF-539 | 5.8 | Lung ca. (squam.) NCI-H596 | 22.4 |
| astrocytoma SNB-75 | 1.7 | Mammary gland | 1.4 |
| glioma SNB-19 | 23.8 | Breast ca.* (pl. ef) MCF-7 | 0.8 |
| glioma U251 | 2.9 | Breast ca.* (pl. ef) MDA-MB-231 | 0.1 |
| glioma SF-295 | 100.0 | Breast ca.* (pl.ef) T47D | 18.4 |
| Heart | 31.6 | Breast ca. BT-549 | 0.1 |
| Skeletal Muscle | 3.4 | Breast ca. MDA-N | 0.0 |
| Bone marrow | 0.2 | Ovary | 6.9 |
| Thymus | 0.2 | Ovarian ca. OVCAR-3 | 1.7 |
| Spleen | 2.1 | Ovarian ca. OVCAR-4 | 12.9 |
| Lymph node | 0.5 | Ovarian ca. OVCAR-5 | 5.7 |
| Colorectal | 1.4 | Ovarian ca. OVCAR-8 | 5.3 |
| Stomach | 1.3 | Ovarian ca. IGROV-1 | 0.8 |
| Small intestine | 3.3 | Ovarian ca. (ascites) SK-OV-3 | 5.4 |
| Colon ca. SW480 | 0.8 | Uterus | 0.9 |
| Colon ca.* SW620 (SW480 met) | 2.2 | Placenta | 0.9 |
| Colon ca. HT29 | 0.1 | Prostate | 10.0 |
| Colon ca. HCT-116 | 7.5 | Prostate ca.* (bone met) PC-3 | 0.1 |
| Colon ca. CaCo-2 | 6.3 | Testis | 0.3 |
| CC Well to Mod Diff (ODO3866) | 3.0 | Melanoma Hs688(A).T | 21.2 |
| Colon ca. HCC-2998 | 1.2 | Melanoma* (met) Hs688(B).T | 28.5 |
| Gastric ca. (liver met) NCI-N87 | 24.7 | Melanoma UACC-62 | 2.4 |
| Bladder | 12.8 | Melanoma M14 | 0.1 |
| Trachea | 0.3 | Melanoma LOX IMVI | 0.1 |

TABLE 19-continued

Panel 1.2

| Tissue Name | Rel. Exp. (%) Ag1522, Run 142131145 | Tissue Name | Rel. Exp. (%) Ag1522, Run 142131145 |
|---|---|---|---|
| Kidney | 19.2 | Melanoma* (met) SK-MEL-5 | 1.2 |
| Kidney (fetal) | 6.6 | | |

TABLE 20

Panel 1.3D

| Tissue Name | Rel. Exp. (%) Ag1522, Run 159601761 | Rel. Exp. (%) Ag1848, Run 160201402 | Rel. Exp. (%) Ag2263, Run 166011650 | Rel. Exp. (%) Ag2422, Run 159319549 |
|---|---|---|---|---|
| Liver adenocarcinoma | 15.8 | 12.3 | 31.4 | 18.3 |
| Pancreas | 1.7 | 1.4 | 2.8 | 2.9 |
| Pancreatic ca. CAPAN 2 | 6.7 | 4.6 | 21.6 | 5.5 |
| Adrenal gland | 3.9 | 2.0 | 3.5 | 3.0 |
| Thyroid | 1.7 | 1.5 | 0.0 | 2.5 |
| Salivary gland | 0.6 | 0.2 | 2.3 | 0.3 |
| Pituitary gland | 2.1 | 1.4 | 2.9 | 4.3 |
| Brain (fetal) | 1.4 | 1.1 | 3.5 | 1.1 |
| Brain (whole) | 28.7 | 13.5 | 43.2 | 10.4 |
| Brain (amygdala) | 16.8 | 13.0 | 31.2 | 18.6 |
| Brain (cerebellum) | 8.2 | 6.5 | 42.3 | 9.2 |
| Brain (hippocampus) | 60.7 | 47.6 | 16.8 | 51.8 |
| Brain (substantia nigra) | 8.9 | 5.2 | 32.3 | 6.8 |
| Brain (thalamus) | 40.1 | 22.2 | 62.0 | 19.8 |
| Cerebral Cortex | 25.9 | 18.4 | 36.6 | 14.3 |
| Spinal cord | 10.2 | 5.4 | 37.9 | 7.9 |
| glio/astro U87-MG | 43.2 | 34.6 | 100.0 | 48.6 |
| glio/astro U-118-MG | 10.2 | 8.0 | 6.4 | 7.5 |
| astrocytoma SW1783 | 0.9 | 0.8 | 2.8 | 1.1 |
| neuro*; met SK-N-AS | 100.0 | 100.0 | 59.0 | 100.0 |
| astrocytoma SF-539 | 9.7 | 8.3 | 17.7 | 9.0 |
| astrocytoma SNB-75 | 12.9 | 12.1 | 8.4 | 12.1 |
| glioma SNB-19 | 19.5 | 17.6 | 46.3 | 17.2 |
| glioma U251 | 13.4 | 10.6 | 24.5 | 10.9 |
| glioma SF-295 | 66.9 | 62.4 | 64.2 | 62.0 |
| Heart (Fetal) | 15.6 | 12.5 | 20.0 | 18.7 |
| Heart | 2.2 | 1.1 | 3.4 | 3.3 |
| Skeletal muscle (Fetal) | 22.2 | 14.0 | 6.7 | 19.3 |
| Skeletal muscle | 0.3 | 0.2 | 1.4 | 0.7 |
| Bone marrow | 0.7 | 0.3 | 0.4 | 0.8 |
| Thymus | 2.0 | 1.6 | 3.6 | 3.4 |
| Spleen | 7.9 | 5.6 | 4.5 | 5.9 |
| Lymph node | 2.6 | 1.9 | 2.7 | 2.1 |
| Colorectal | 4.7 | 9.2 | 12.8 | 10.3 |
| Stomach | 6.1 | 2.4 | 3.6 | 4.5 |
| Small intestine | 2.9 | 2.9 | 4.5 | 4.9 |
| Colon ca. SW480 | 2.0 | 1.0 | 1.9 | 1.5 |
| Colon ca.* SW620 (SW480 met) | 1.0 | 1.2 | 2.0 | 2.1 |
| Colon ca. HT29 | 0.1 | 0.1 | 0.0 | 0.1 |
| Colon ca. HCT-116 | 4.2 | 2.9 | 4.7 | 5.6 |
| Colon ca. CaCo-2 | 5.3 | 3.9 | 12.5 | 7.2 |
| CC Well to Mod Diff (ODO3866) | 14.8 | 17.3 | 19.8 | 23.5 |
| Colon ca. HCC-2998 | 0.7 | 1.6 | 0.0 | 0.5 |
| Gastric ca. (liver met) NCI-N87 | 21.9 | 22.8 | 19.1 | 25.7 |
| Bladder | 2.1 | 1.7 | 3.4 | 1.5 |
| Trachea | 12.2 | 6.8 | 1.6 | 13.8 |
| Kidney | 1.4 | 0.6 | 3.9 | 3.0 |
| Kidney (fetal) | 5.3 | 5.8 | 5.2 | 6.3 |
| Renal ca. 786-0 | 0.1 | 0.0 | 0.0 | 0.0 |
| Renal ca. A498 | 7.7 | 7.9 | 6.8 | 9.7 |
| Renal ca. RXF 393 | 0.1 | 3.6 | 0.8 | 0.1 |
| Renal ca. ACHN | 0.0 | 0.0 | 0.0 | 0.0 |
| Renal ca. UO-31 | 0.2 | 0.3 | 0.5 | 0.3 |
| Renal ca. TK-10 | 0.1 | 0.0 | 0.0 | 0.0 |
| Liver | 0.3 | 0.1 | 0.0 | 0.6 |
| Liver (fetal) | 1.1 | 1.0 | 0.3 | 1.2 |
| Liver ca. (hepatoblast) HepG2 | 0.2 | 0.0 | 0.8 | 0.3 |

TABLE 20-continued

Panel 1.3D

| Tissue Name | Rel. Exp. (%) Ag1522, Run 159601761 | Rel. Exp. (%) Ag1848, Run 160201402 | Rel. Exp. (%) Ag2263, Run 166011650 | Rel. Exp. (%) Ag2422, Run 159319549 |
|---|---|---|---|---|
| Lung | 8.2 | 9.4 | 4.1 | 10.3 |
| Lung (fetal) | 4.3 | 4.2 | 7.3 | 4.5 |
| Lung ca. (small cell) LX-1 | 8.4 | 6.9 | 31.6 | 9.9 |
| Lung ca. (small cell) NCI-H69 | 44.4 | 48.6 | 90.8 | 54.3 |
| Lung ca. (s. cell var.) SHP-77 | 0.7 | 0.8 | 0.5 | 1.1 |
| Lung ca. (large cell) NCI-H460 | 16.2 | 11.9 | 22.4 | 12.1 |
| Lung ca. (non-sm. cell) A549 | 0.4 | 0.3 | 0.2 | 0.4 |
| Lung ca. (non-s. cell) NCI-H23 | 2.0 | 0.9 | 3.3 | 1.2 |
| Lung ca. (non-s. cell) HOP-62 | 0.4 | 0.9 | 1.6 | 0.7 |
| Lung ca. (non-s. cl) NCI-H522 | 1.7 | 0.8 | 1.7 | 1.1 |
| Lung ca. (squam.) SW 900 | 0.5 | 0.3 | 1.9 | 0.2 |
| Lung ca. (squam.) NCI-H596 | 4.0 | 4.1 | 26.4 | 2.4 |
| Mammary gland | 6.3 | 4.4 | 3.0 | 2.8 |
| Breast ca.* (pl. ef) MCF-7 | 1.1 | 0.4 | 1.5 | 0.9 |
| Breast ca.* (pl. ef) MDA-MB-231 | 0.8 | 1.2 | 0.7 | 1.4 |
| Breast ca.* (pl. ef) T47D | 9.6 | 5.7 | 14.0 | 4.5 |
| Breast ca. BT-549 | 0.2 | 0.3 | 0.2 | 0.3 |
| Breast ca. MDA-N | 0.0 | 0.0 | 0.0 | 0.0 |
| Ovary | 6.4 | 4.9 | 6.2 | 9.5 |
| Ovarian ca. OVCAR-3 | 1.1 | 0.6 | 1.1 | 0.8 |
| Ovarian ca. OVCAR-4 | 1.0 | 1.4 | 11.4 | 1.5 |
| Ovarian ca. OVCAR-5 | 2.4 | 2.6 | 5.7 | 3.3 |
| Ovarian ca. OVCAR-8 | 3.6 | 1.6 | 2.6 | 5.4 |
| Ovarian ca. IGROV-1 | 0.6 | 0.2 | 0.7 | 0.2 |
| Ovarian ca. (ascites) SK-OV-3 | 2.0 | 2.6 | 2.1 | 1.1 |
| Uterus | 2.7 | 1.3 | 3.9 | 4.2 |
| Placenta | 2.0 | 2.0 | 5.8 | 4.8 |
| Prostate | 4.4 | 2.5 | 3.4 | 5.4 |
| Prostate ca.* (bone met) PC-3 | 0.1 | 0.1 | 0.2 | 0.0 |
| Testis | 8.1 | 5.5 | 3.5 | 6.4 |
| Melanoma Hs688(A).T | 31.6 | 25.0 | 59.5 | 27.4 |
| Melanoma* (met) Hs688(B).T | 46.0 | 17.1 | 87.1 | 28.5 |
| Melanoma UACC-62 | 0.1 | 0.2 | 2.0 | 0.5 |
| Melanoma M14 | 0.0 | 0.0 | 0.0 | 0.0 |
| Melanoma LOX IMVI | 0.1 | 0.2 | 0.0 | 0.1 |
| Melanoma* (met) SK-MEL-5 | 0.9 | 0.9 | 1.7 | 0.6 |
| Adipose | 3.6 | 2.3 | 5.1 | 2.9 |

TABLE 21

Panel 2D

| Tissue Name | Rel. Exp. (%) Ag1522, Run 145049854 | Rel. Exp. (%) Ag1522, Run 145492337 | Rel. Exp. (%) Ag1848, Run 160202834 | Rel. Exp. (%) Ag2263, Run 165725935 | Rel. Exp. (%) Ag2422, Run 159317774 |
|---|---|---|---|---|---|
| Normal Colon | 20.2 | 46.0 | 35.1 | 59.0 | 36.9 |
| CC Well to Mod Diff (ODO3866) | 15.3 | 45.1 | 22.5 | 21.8 | 21.3 |
| CC Margin (ODO3866) | 6.1 | 15.2 | 7.4 | 7.7 | 5.5 |
| CC Gr.2 rectosigmoid (ODO3868) | 7.0 | 8.2 | 5.8 | 5.9 | 13.2 |
| CC Margin (ODO3868) | 0.3 | 0.5 | 0.5 | 9.3 | 0.8 |
| CC Mod Diff (ODO3920) | 1.2 | 4.0 | 2.5 | 5.6 | 5.8 |
| CC Margin (ODO3920) | 3.0 | 4.7 | 4.1 | 5.4 | 7.2 |
| CC Gr.2 ascend colon (ODO3921) | 10.7 | 22.5 | 24.1 | 19.9 | 25.5 |
| CC Margin (ODO3921) | 3.6 | 4.3 | 7.3 | 5.6 | 5.8 |
| CC from Partial Hepatectomy (ODO4309) Mets | 12.1 | 19.9 | 20.7 | 19.3 | 27.0 |

TABLE 21-continued

Panel 2D

| Tissue Name | Rel. Exp. (%) Ag1522, Run 145049854 | Rel. Exp. (%) Ag1522, Run 145492337 | Rel. Exp. (%) Ag1848, Run 160202834 | Rel. Exp. (%) Ag2263, Run 165725935 | Rel. Exp. (%) Ag2422, Run 159317774 |
|---|---|---|---|---|---|
| Liver Margin (OD04309) | 0.4 | 3.6 | 2.4 | 2.6 | 3.3 |
| Colon mets to lung (OD04451-01) | 5.8 | 11.9 | 6.1 | 8.5 | 10.7 |
| Lung Margin (OD04451-02) | 9.3 | 17.7 | 7.7 | 10.0 | 15.4 |
| Normal Prostate 6546-1 | 10.5 | 51.1 | 7.3 | 21.6 | 7.0 |
| Prostate Cancer (OD04410) | 12.2 | 14.9 | 14.9 | 9.0 | 17.4 |
| Prostate Margin (OD04410) | 14.6 | 13.8 | 25.3 | 19.2 | 29.7 |
| Prostate Cancer (OD04720-01) | 12.2 | 18.0 | 22.7 | 31.6 | 30.6 |
| Prostate Margin (OD04720-02) | 11.8 | 11.8 | 17.7 | 16.7 | 25.0 |
| Normal Lung | 7.3 | 17.8 | 17.6 | 12.8 | 22.4 |
| Lung Met to Muscle (OD04286) | 12.7 | 27.4 | 25.0 | 31.0 | 22.1 |
| Muscle Margin (OD04286) | 7.4 | 8.7 | 6.2 | 7.3 | 9.5 |
| Lung Malignant Cancer (OD03126) | 22.7 | 27.4 | 26.1 | 28.3 | 20.4 |
| Lung Margin (OD03126) | 12.7 | 21.9 | 21.9 | 13.9 | 31.9 |
| Lung Cancer (OD04404) | 17.9 | 41.5 | 41.5 | 30.4 | 48.0 |
| Lung Margin (OD04404) | 16.4 | 28.7 | 10.0 | 11.8 | 12.4 |
| Lung Cancer (OD04565) | 22.5 | 38.2 | 28.5 | 27.9 | 40.6 |
| Lung Margin (OD04565) | 8.1 | 11.7 | 8.5 | 8.6 | 16.3 |
| Lung Cancer (OD04237-01) | 9.8 | 7.1 | 10.9 | 8.8 | 9.6 |
| Lung Margin (OD04237-02) | 12.9 | 23.0 | 14.3 | 14.0 | 16.0 |
| Ocular Mel Met to Liver (OD04310) | 0.6 | 0.5 | 0.7 | 0.5 | 1.1 |
| Liver Margin (OD04310) | 3.5 | 2.6 | 1.8 | 3.3 | 3.0 |
| Melanoma Metastasis | 1.4 | 2.0 | 3.6 | 4.3 | 2.9 |
| Lung Margin (OD04321) | 20.4 | 14.4 | 25.2 | 24.0 | 18.6 |
| Normal Kidney | 20.2 | 19.9 | 18.0 | 17.4 | 26.1 |
| Kidney Ca, Nuclear grade 2 (OD04338) | 1.7 | 4.2 | 2.9 | 2.7 | 4.9 |
| Kidney Margin (OD04338) | 6.2 | 11.7 | 17.2 | 11.3 | 22.8 |
| Kidney Ca Nuclear grade 1/2 (OD04339) | 3.6 | 10.0 | 3.7 | 4.6 | 6.6 |
| Kidney Margin (OD04339) | 11.7 | 12.2 | 11.4 | 12.1 | 11.0 |
| Kidney Ca, Clear cell type (OD04340) | 46.7 | 50.7 | 66.0 | 65.1 | 70.7 |
| Kidney Margin (OD04340) | 15.3 | 19.1 | 14.8 | 12.9 | 16.8 |
| Kidney Ca, Nuclear grade 3 (OD04348) | 21.0 | 9.5 | 16.3 | 16.8 | 17.0 |
| Kidney Margin (OD04348) | 8.2 | 5.8 | 8.8 | 11.5 | 9.3 |
| Kidney Cancer (OD04622-01) | 24.0 | 25.3 | 27.7 | 24.8 | 41.5 |
| Kidney Margin | 2.1 | 4.6 | 3.4 | 3.1 | 5.9 |

TABLE 21-continued

Panel 2D

| Tissue Name | Rel. Exp. (%) Ag1522, Run 145049854 | Rel. Exp. (%) Ag1522, Run 145492337 | Rel. Exp. (%) Ag1848, Run 160202834 | Rel. Exp. (%) Ag2263, Run 165725935 | Rel. Exp. (%) Ag2422, Run 159317774 |
|---|---|---|---|---|---|
| (OD04622-03) | | | | | |
| Kidney Cancer (OD04450-01) | 0.2 | 0.0 | 0.2 | 0.5 | 0.5 |
| Kidney Margin (OD04450-03) | 5.9 | 6.3 | 9.3 | 9.9 | 12.9 |
| Kidney Cancer 8120607 | 7.3 | 9.1 | 11.9 | 12.8 | 13.4 |
| Kidney Margin 8120608 | 12.2 | 6.2 | 7.9 | 5.6 | 8.0 |
| Kidney Cancer 8120613 | 3.6 | 8.0 | 5.2 | 8.8 | 10.1 |
| Kidney Margin 8120614 | 6.3 | 6.7 | 8.9 | 7.5 | 9.3 |
| Kidney Cancer 9010320 | 18.7 | 61.1 | 25.0 | 21.9 | 22.1 |
| Kidney Margin 9010321 | 14.0 | 20.3 | 16.4 | 12.9 | 17.9 |
| Normal Uterus | 4.1 | 5.6 | 3.3 | 8.4 | 6.0 |
| Uterine Cancer 064011 | 9.6 | 10.7 | 17.1 | 11.7 | 15.6 |
| Normal Thyroid | 2.6 | 9.2 | 2.6 | 1.5 | 3.6 |
| Thyroid Cancer | 100.0 | 72.7 | 100.0 | 82.9 | 100.0 |
| Thyroid Cancer A302152 | 7.6 | 4.5 | 12.5 | 8.0 | 11.7 |
| Thyroid Margin A302153 | 3.0 | 2.4 | 2.8 | 3.2 | 6.0 |
| Normal Breast | 10.3 | 5.7 | 9.9 | 12.9 | 7.2 |
| Breast Cancer | 11.7 | 15.9 | 12.8 | 12.9 | 12.8 |
| Breast Cancer (OD04590-01) | 17.9 | 39.0 | 27.2 | 16.5 | 25.3 |
| Breast Cancer Mets (OD04590-03) | 26.1 | 66.0 | 35.4 | 42.0 | 27.9 |
| Breast Cancer Metastasis | 4.5 | 5.4 | 6.0 | 5.2 | 3.5 |
| Breast Cancer | 30.8 | 32.1 | 28.1 | 21.6 | 36.3 |
| Breast Cancer | 20.7 | 46.7 | 19.8 | 16.7 | 14.8 |
| Breast Cancer 9100266 | 13.1 | 15.9 | 13.9 | 11.0 | 22.1 |
| Breast Margin 9100265 | 10.4 | 14.4 | 15.6 | 16.4 | 20.9 |
| Breast Cancer A209073 | 22.2 | 26.8 | 34.2 | 25.5 | 50.0 |
| Breast Margin A2090734 | 6.7 | 9.7 | 7.1 | 4.3 | 11.3 |
| Normal Liver | 1.4 | 4.2 | 1.6 | 1.7 | 2.3 |
| Liver Cancer | 1.0 | 2.8 | 1.7 | 1.3 | 1.3 |
| Liver Cancer 1025 | 1.4 | 1.1 | 3.3 | 2.3 | 3.2 |
| Liver Cancer 1026 | 7.8 | 6.5 | 4.9 | 6.4 | 10.7 |
| Liver Cancer 6004-T | 5.0 | 9.9 | 4.2 | 3.0 | 5.2 |
| Liver Tissue 6004-N | 4.7 | 7.9 | 3.5 | 4.2 | 3.7 |
| Liver Cancer 6005-T | 7.9 | 11.5 | 8.2 | 10.3 | 6.7 |
| Liver Tissue 6005-N | 2.0 | 3.2 | 2.7 | 1.6 | 2.3 |
| Normal Bladder | 6.8 | 17.9 | 13.6 | 11.5 | 15.2 |
| Bladder Cancer | 10.7 | 22.8 | 14.5 | 14.2 | 14.2 |
| Bladder Cancer | 18.0 | 29.3 | 22.7 | 17.7 | 23.5 |
| Bladder Cancer (OD04718-01) | 14.5 | 29.3 | 26.1 | 21.0 | 28.3 |
| Bladder Normal Adjacent (OD04718-03) | 2.9 | 5.0 | 3.1 | 3.2 | 4.2 |
| Normal Ovary | 1.4 | 4.7 | 3.6 | 4.6 | 5.4 |
| Ovarian Cancer | 40.9 | 100.0 | 89.5 | 100.0 | 76.3 |
| Ovarian Cancer (OD04768-07) | 9.7 | 43.2 | 16.7 | 15.6 | 19.5 |
| Ovary Margin (OD04768-08) | 6.5 | 7.9 | 10.8 | 6.7 | 8.3 |

TABLE 21-continued

Panel 2D

| Tissue Name | Rel. Exp. (%) Ag1522, Run 145049854 | Rel. Exp. (%) Ag1522, Run 145492337 | Rel. Exp. (%) Ag1848, Run 160202834 | Rel. Exp. (%) Ag2263, Run 165725935 | Rel. Exp. (%) Ag2422, Run 159317774 |
|---|---|---|---|---|---|
| Normal Stomach | 11.8 | 39.5 | 14.7 | 14.8 | 13.1 |
| Gastric Cancer 9060358 | 1.4 | 6.0 | 2.9 | 2.8 | 2.9 |
| Stomach Margin 9060359 | 6.4 | 19.9 | 7.4 | 10.8 | 8.7 |
| Gastric Cancer 9060395 | 11.1 | 58.6 | 21.6 | 21.2 | 32.3 |
| Stomach Margin 9060394 | 6.8 | 34.6 | 23.7 | 13.8 | 22.2 |
| Gastric Cancer 9060397 | 15.4 | 78.5 | 24.8 | 25.2 | 31.9 |
| Stomach Margin 9060396 | 3.9 | 14.5 | 6.1 | 7.5 | 7.9 |
| Gastric Cancer 064005 | 2.5 | 14.8 | 7.0 | 7.3 | 13.0 |

TABLE 22

Panel 3D

| Tissue Name | Rel. Exp. (%) Ag2263, Run 170189128 | Tissue Name | Rel. Exp. (%) Ag2263, Run 170189128 |
|---|---|---|---|
| Daoy- Medulloblastoma | 19.1 | Ca Ski- Cervical epidermoid carcinoma (metastasis) | 0.4 |
| TE671- Medulloblastoma | 8.4 | ES-2- Ovarian clear cell carcinoma | 0.0 |
| D283 Med- Medulloblastoma | 39.2 | Ramos- Stimulated with PMA/ionomycin 6h | 0.0 |
| PFSK-1- Primitive Neuroectodermal | 59.5 | Ramos- Stimulated with PMA/ionomycin 14h | 0.0 |
| XF-498- CNS | 0.9 | MEG-01-Chronic myelogenous leukemia (megokaryoblast) | 3.8 |
| SNB-78- Glioma | 35.4 | Raji- Burkitt's lymphoma | 0.0 |
| SF-268- Glioblastoma | 0.0 | Daudi- Burkitt's lymphoma | 0.0 |
| T98G- Glioblastoma | 1.2 | U266- B-cell plasmacytoma | 0.0 |
| SK-N-SH- Neuroblastoma (metastasis) | 94.6 | CA46- Burkitt's lymphoma | 0.0 |
| SF-295- Glioblastoma | 0.3 | RL- non-Hodgkin's B-cell lymphoma | 0.0 |
| Cerebellum | 37.4 | JM1- pre-B-cell lymphoma | 0.0 |
| Cerebellum | 35.1 | Jurkat- T cell leukemia | 0.5 |
| NCI-H292- Mucoepidermoid lung carcinoma | 4.3 | TF-1- Erythroleukemia | 73.2 |
| DMS-114- Small cell lung cancer | 6.6 | HUT 78- T-cell lymphoma | 0.0 |
| DMS-79- Small cell lung cancer | 100.0 | U937- Histiocytic lymphoma | 0.0 |
| NCI-H146- Small cell lung cancer | 37.4 | KU-812- Myelogenous leukemia | 0.6 |
| NCI-H526- Small cell lung cancer | 17.2 | 769-P- Clear cell renal carcinoma | 0.0 |
| NCI-N417- Small cell lung cancer | 88.9 | Caki-2- Clear cell renal carcinoma | 0.0 |
| NCI-H82- Small cell lung cancer | 95.3 | SW 839- Clear cell renal carcinoma | 0.0 |
| NCI-H157-Squamous cell lung cancer (metastasis) | 0.8 | G401-Wilms' tumor | 2.8 |
| NCI-H1155- Large cell lung cancer | 55.5 | Hs766T- Pancreatic carcinoma (LN metastasis) | 0.6 |
| NCI-H1299- Large cell lung cancer | 0.0 | CAPAN-1- Pancreatic adenocarcinoma (liver metastasis) | 3.1 |
| NCI-H727- Lung carcinoid | 0.7 | SU86.86- Pancreatic carcinoma (liver metastasis) | 0.4 |

TABLE 22-continued

Panel 3D

| Tissue Name | Rel. Exp. (%) Ag2263, Run 170189128 | Tissue Name | Rel. Exp. (%) Ag2263, Run 170189128 |
|---|---|---|---|
| NCI-UMC-11- Lung carcinoid | 7.9 | BxPC-3- Pancreatic adenocarcinoma | 22.8 |
| LX-1- Small cell lung cancer | 1.8 | HPAC- Pancreatic adenocarcinoma | 35.6 |
| Colo-205- Colon cancer | 0.3 | MIA PaCa-2- Pancreatic carcinoma | 0.6 |
| KM12- Colon cancer | 0.1 | CFPAC-1- Pancreatic ductal adenocarcinoma | 1.1 |
| KM20L2- Colon cancer | 0.6 | PANC-1- Pancreatic epithelioid ductal carcinoma | 0.3 |
| NCI-H716- Colon cancer | 70.2 | T24- Bladder carcinma (transitional cell) | 0.0 |
| SW-48- Colon adenocarcinoma | 0.0 | 5637- Bladder carcinoma | 2.2 |
| SW1116- Colon adenocarcinoma | 16.6 | HT-1197- Bladder carcinoma | 0.4 |
| LS 174T- Colon adenocarcinoma | 4.2 | UM-UC-3- Bladder carcinma (transitional cell) | 0.2 |
| SW-948- Colon adenocarcinoma | 0.4 | A204- Rhabdomyosarcoma | 0.0 |
| SW-480- Colon adenocarcinoma | 0.0 | HT-1080- Fibrosarcoma | 7.9 |
| NCI-SNU-5- Gastric carcinoma | 1.7 | MG-63- Osteosarcoma | 16.3 |
| KATO III- Gastric carcinoma | 17.4 | SK-LMS-1- Leiomyosarcoma (vulva) | 0.0 |
| NCI-SNU-16- Gastric carcinoma | 0.7 | SJRH30- Rhabdomyosarcoma (met to bone marrow) | 3.9 |
| NCI-SNU-1- Gastric carcinoma | 23.0 | A431- Epidermoid carcinoma | 34.9 |
| RF-1- Gastric adenocarcinoma | 0.0 | WM266-4- Melanoma | 0.0 |
| RF-48- Gastric adenocarcinoma | 0.0 | DU 145- Prostate carcinoma (brain metastasis) | 0.0 |
| MKN-45- Gastric carcinoma | 11.5 | MDA-MB-468- Breast adenocarcinoma | 16.4 |
| NCI-N87- Gastric carcinoma | 24.0 | SCC-4- Squamous cell carcinoma of tongue | 0.0 |
| OVCAR-5- Ovarian carcinoma | 3.7 | SCC-9- Squamous cell carcinoma of tongue | 0.0 |
| RL95-2- Uterine carcinoma | 4.6 | SCC-15- Squamous cell carcinoma of tongue | 0.0 |
| HelaS3- Cervical adenocarcinoma | 5.9 | CAL 27- Squamous cell carcinoma of tongue | 7.1 |

TABLE 23

Panel 4D

| Tissue Name | Rel. Exp. (%) Ag1522, Run 145789191 | Rel. Exp. (%) Ag1848, Run 160202841 | Rel. Exp. (%) Ag2263, Run 151562852 | Rel. Exp. (%) Ag2422, Run 159318890 |
|---|---|---|---|---|
| Secondary Th1 act | 0.0 | 0.1 | 0.0 | 0.2 |
| Secondary Th2 act | 0.0 | 0.0 | 0.0 | 0.0 |
| Secondary Tr1 act | 0.0 | 0.0 | 0.0 | 4.6 |
| Secondary Th1 rest | 0.1 | 0.0 | 0.1 | 0.0 |
| Secondary Th2 rest | 0.0 | 0.0 | 0.0 | 0.0 |
| Secondary Tr1 rest | 0.0 | 0.0 | 0.0 | 0.2 |
| Primary Th1 act | 0.1 | 0.2 | 0.2 | 1.0 |
| Primary Th2 act | 0.1 | 0.2 | 0.1 | 0.3 |
| Primary Tr1 act | 0.2 | 0.5 | 0.0 | 0.6 |
| Primary Th1 rest | 0.0 | 0.0 | 0.0 | 0.0 |
| Primary Th2 rest | 0.0 | 0.0 | 0.0 | 0.0 |
| Primary Tr1 rest | 0.0 | 0.0 | 0.0 | 0.0 |
| CD45RA CD4 lymphocyte act | 4.9 | 6.3 | 8.5 | 10.6 |
| CD45RO CD4 lymphocyte act | 0.0 | 0.0 | 0.0 | 0.0 |
| CD8 lymphocyte act | 0.0 | 0.0 | 0.0 | 0.0 |

TABLE 23-continued

Panel 4D

| Tissue Name | Rel. Exp. (%) Ag1522, Run 145789191 | Rel. Exp. (%) Ag1848, Run 160202841 | Rel. Exp. (%) Ag2263, Run 151562852 | Rel. Exp. (%) Ag2422, Run 159318890 |
|---|---|---|---|---|
| Secondary CD8 lymphocyte rest | 0.0 | 0.0 | 0.0 | 0.0 |
| Secondary CD8 lymphocyte act | 0.0 | 0.0 | 0.0 | 0.0 |
| CD4 lymphocyte none | 0.0 | 0.0 | 0.0 | 0.0 |
| 2ry Th1/Th2/Tr1_anti-CD95 CH11 | 0.0 | 0.0 | 0.0 | 0.0 |
| LAK cells rest | 1.8 | 2.7 | 2.0 | 5.8 |
| LAK cells IL-2 | 0.0 | 0.0 | 0.0 | 0.0 |
| LAK cells IL-2 + IL-12 | 0.0 | 0.1 | 0.0 | 0.2 |
| LAK cells IL-2 + IFN gamma | 0.0 | 0.1 | 0.0 | 0.2 |
| LAK cells IL-2 + IL-18 | 0.0 | 0.4 | 0.0 | 0.1 |
| LAK cells PMA/ionomycin | 1.1 | 1.0 | 1.7 | 2.5 |
| NK Cells IL-2 rest | 0.0 | 0.1 | 0.0 | 0.0 |
| Two Way MLR 3 day | 0.0 | 0.1 | 0.2 | 0.2 |
| Two Way MLR 5 day | 0.2 | 0.3 | 0.8 | 0.6 |
| Two Way MLR 7 day | 0.5 | 0.2 | 0.1 | 0.3 |
| PBMC rest | 0.0 | 0.0 | 0.1 | 0.0 |
| PBMC PWM | 0.0 | 0.1 | 0.0 | 0.0 |
| PBMC PHA-L | 0.0 | 0.1 | 0.0 | 0.0 |
| Ramos (B cell) none | 0.0 | 0.0 | 0.0 | 0.0 |
| Ramos (B cell) ionomycin | 0.0 | 0.0 | 0.0 | 0.0 |
| B lymphocytes PWM | 0.2 | 0.0 | 0.0 | 0.0 |
| B lymphocytes CD40L and IL-4 | 0.0 | 0.1 | 0.1 | 0.3 |
| EOL-1 dbcAMP | 0.2 | 0.2 | 0.4 | 0.0 |
| EOL-1 dbcAMP PMA/ionomycin | 0.1 | 0.4 | 0.2 | 0.6 |
| Dendritic cells none | 1.4 | 1.1 | 1.0 | 2.8 |
| Dendritic cells LPS | 0.3 | 0.4 | 0.3 | 0.4 |
| Dendritic cells anti-CD40 | 2.4 | 3.0 | 3.5 | 6.7 |
| Monocytes rest | 0.8 | 0.8 | 0.6 | 1.3 |
| Monocytes LPS | 0.0 | 0.0 | 0.3 | 0.0 |
| Macrophages rest | 1.3 | 1.0 | 0.0 | 2.0 |
| Macrophages LPS | 0.0 | 0.2 | 0.1 | 0.4 |
| HUVEC none | 1.1 | 1.4 | 0.6 | 2.5 |
| HUVEC starved | 4.4 | 4.7 | 2.9 | 6.0 |
| HUVEC IL-1beta | 1.7 | 2.8 | 1.0 | 2.3 |
| HUVEC IFN gamma | 1.6 | 1.4 | 2.5 | 1.9 |
| HUVEC TNF alpha + IFN gamma | 0.3 | 0.3 | 0.5 | 0.5 |
| HUVEC TNF alpha + IL4 | 0.2 | 0.3 | 0.3 | 1.3 |
| HUVEC IL-11 | 0.9 | 1.2 | 2.2 | 0.5 |
| Lung Microvascular EC none | 2.2 | 6.5 | 2.8 | 6.7 |
| Lung Microvascular EC TNFalpha + IL-1beta | 12.7 | 11.9 | 8.5 | 15.5 |
| Microvascular Dermal EC none | 32.1 | 30.8 | 22.4 | 22.4 |
| Microsvasular Dermal EC TNFalpha + IL-1beta | 16.3 | 16.2 | 8.8 | 14.4 |
| Bronchial epithelium TNFalpha + IL1beta | 24.0 | 31.2 | 15.1 | 50.7 |
| Small airway epithelium none | 8.8 | 5.9 | 6.7 | 12.8 |
| Small airway epithelium TNFalpha + IL-1beta | 31.9 | 43.5 | 21.0 | 44.8 |
| Coronery artery SMC rest | 27.4 | 28.7 | 8.5 | 35.8 |
| Coronery artery SMC TNFalpha + IL-1beta | 12.9 | 21.6 | 27.4 | 17.8 |
| Astrocytes rest | 17.1 | 14.9 | 23.8 | 24.3 |
| Astrocytes TNFalpha + IL-1beta | 32.8 | 29.5 | 28.1 | 35.1 |
| KU-812 (Basophil) rest | 1.0 | 1.8 | 1.3 | 0.7 |
| KU-812 (Basophil) PMA/ionomycin | 1.4 | 3.3 | 2.0 | 3.7 |

TABLE 23-continued

Panel 4D

| Tissue Name | Rel. Exp. (%) Ag1522, Run 145789191 | Rel. Exp. (%) Ag1848, Run 160202841 | Rel. Exp. (%) Ag2263, Run 151562852 | Rel. Exp. (%) Ag2422, Run 159318890 |
|---|---|---|---|---|
| CCD1106 (Keratinocytes) none | 1.4 | 0.2 | 0.7 | 2.7 |
| CCD1106 (Keratinocytes) TNFalpha + IL-1beta | 0.9 | 0.3 | 0.8 | 1.3 |
| Liver cirrhosis | 2.9 | 3.0 | 2.4 | 4.8 |
| Lupus kidney | 3.0 | 2.9 | 0.9 | 4.4 |
| NCI-H292 none | 10.4 | 13.7 | 5.6 | 18.8 |
| NCI-H292 IL-4 | 14.2 | 14.9 | 6.8 | 17.1 |
| NCI-H292 IL-9 | 13.2 | 16.7 | 9.3 | 12.8 |
| NCI-H292 IL-13 | 9.4 | 8.6 | 15.9 | 9.0 |
| NCI-H292 IFN gamma | 3.8 | 4.7 | 4.7 | 5.3 |
| HPAEC none | 1.2 | 1.0 | 1.6 | 2.8 |
| HPAEC TNF alpha + IL-1 beta | 5.8 | 2.6 | 4.7 | 6.0 |
| Lung fibroblast none | 100.0 | 100.0 | 100.0 | 100.0 |
| Lung fibroblast TNF alpha + IL-1 beta | 8.5 | 12.2 | 15.9 | 15.2 |
| Lung fibroblast IL-4 | 74.2 | 79.6 | 45.7 | 97.3 |
| Lung fibroblast IL-9 | 27.7 | 48.6 | 30.6 | 50.3 |
| Lung fibroblast IL-13 | 48.0 | 39.5 | 27.4 | 55.9 |
| Lung fibroblast IFN gamma | 76.3 | 82.9 | 42.6 | 98.6 |
| Dermal fibroblast CCD1070 rest | 52.9 | 56.3 | 27.2 | 65.5 |
| Dermal fibroblast CCD1070 TNF alpha | 33.9 | 42.6 | 19.8 | 46.7 |
| Dermal fibroblast CCD1070 IL-1 beta | 29.1 | 27.9 | 70.2 | 28.9 |
| Dermal fibroblast IFN gamma | 6.1 | 3.6 | 8.9 | 7.9 |
| Dermal fibroblast IL-4 | 14.5 | 16.2 | 17.3 | 18.9 |
| IBD Colitis 2 | 0.1 | 0.1 | 0.2 | 0.5 |
| IBD Crohn's | 0.6 | 0.4 | 0.0 | 0.8 |
| Colon | 7.6 | 6.4 | 8.0 | 11.3 |
| Lung | 59.5 | 75.8 | 47.6 | 74.7 |
| Thymus | 16.5 | 17.3 | 10.2 | 19.6 |
| Kidney | 6.8 | 9.0 | 3.0 | 6.5 |

TABLE 24

Panel CNS_1

| Tissue Name | Rel. Exp. (%) Ag2263, Run 171669090 | Tissue Name | Rel. Exp. (%) Ag2263, Run 171669090 |
|---|---|---|---|
| BA4 Control | 22.8 | BA17 PSP | 11.2 |
| BA4 Control2 | 38.2 | BA17 PSP2 | 7.1 |
| BA4 Alzheimer's2 | 3.7 | Sub Nigra Control | 100.0 |
| BA4 Parkinson's | 45.7 | Sub Nigra Control2 | 51.8 |
| BA4 Parkinson's2 | 31.2 | Sub Nigra Alzheimer's2 | 30.8 |
| BA4 Huntington's | 12.3 | Sub Nigra Parkinson's | 89.5 |
| BA4 Huntington's2 | 12.2 | Sub Nigra Huntington's | 59.0 |
| BA4 PSP | 13.6 | Sub Nigra Huntington's2 | 16.2 |
| BA4 PSP2 | 42.6 | Sub Nigra PSP2 | 22.5 |
| BA4 Depression | 27.9 | Sub Nigra Depression | 40.6 |
| BA4 Depression2 | 10.9 | Sub Nigra Depression2 | 12.8 |
| BA7 Control | 28.3 | Glob Palladus Control | 36.1 |
| BA7 Control2 | 27.2 | Glob Palladus Control2 | 21.3 |
| BA7 Alzheimer's2 | 5.5 | Glob Palladus Alzheimer's | 26.1 |
| BA7 Parkinson's | 13.2 | Glob Palladus Alzheimer's2 | 11.2 |
| BA7 Parkinson's2 | 12.8 | Glob Palladus Parkinson's | 73.2 |
| BA7 Huntington's | 14.8 | Glob Palladus Parkinson's2 | 15.7 |
| BA7 Huntington's2 | 22.2 | Glob Palladus PSP | 15.0 |
| BA7 PSP | 29.1 | Glob Palladus PSP2 | 10.4 |
| BA7 PSP2 | 8.9 | Glob Palladus Depression | 28.3 |
| BA7 Depression | 5.4 | Temp Pole Control | 5.4 |
| BA9 Control | 14.3 | Temp Pole Control2 | 25.2 |
| BA9 Control2 | 57.0 | Temp Pole Alzheimer's | 10.0 |

TABLE 24-continued

Panel CNS_1

| Tissue Name | Rel. Exp. (%) Ag2263, Run 171669090 | Tissue Name | Rel. Exp. (%) Ag2263, Run 171669090 |
|---|---|---|---|
| BA9 Alzheimer's | 5.5 | Temp Pole Alzheimer's2 | 2.5 |
| BA9 Alzheimer's2 | 13.8 | Temp Pole Parkinson's | 15.5 |
| BA9 Parkinson's | 16.2 | Temp Pole Parkinson's2 | 27.9 |
| BA9 Parkinson's2 | 21.0 | Temp Pole Huntington's | 22.4 |
| BA9 Huntington's | 21.5 | Temp Pole PSP | 1.3 |
| BA9 Huntington's2 | 11.9 | Temp Pole PSP2 | 6.4 |
| BA9 PSP | 27.7 | Temp Pole Depression2 | 12.3 |
| BA9 PSP2 | 5.9 | Cing Gyr Control | 48.3 |
| BA9 Depression | 11.0 | Cing Gyr Control2 | 28.1 |
| BA9 Depression2 | 9.5 | Cing Gyr Alzheimer's | 27.2 |
| BA17 Control | 25.0 | Cing Gyr Alzheimer's2 | 13.1 |
| BA17 Control2 | 45.7 | Cing Gyr Parkinson's | 29.7 |
| BA17 Alzheimer's2 | 6.5 | Cing Gyr Parkinson's2 | 37.4 |
| BA17 Parkinson's | 35.4 | Cing Gyr Huntington's | 70.7 |
| BA17 Parkinson's2 | 15.3 | Cing Gyr Huntington's2 | 32.1 |
| BA17 Huntington's | 15.5 | Cing Gyr PSP | 42.6 |
| BA17 Huntington's2 | 8.1 | Cing Gyr PSP2 | 8.3 |
| BA17 Depression | 26.2 | Cing Gyr Depression | 20.6 |
| BA17 Depression2 | 59.9 | Cing Gyr Depression2 | 36.3 |

CNS_neurodegeneration_1.0 Summary: Ag1848/Ag2263/Ag2422

Multiple experiments using different probe/primer sets produce results that are in good agreement. Highest expression of a NOV1 gene is detected in the occipital cortex of a control patient. Significant levels of expression are also detected in the hippocampus, inferior temporal cortex, and the superior temporal cortex of brain tissue from an Alzheimer's patient.

Based on its homology, a NOV1 gene product is most similar to an UNC5H receptor, which as a class is known to act both in axon guidance and neuronal migration during development, as well as in inducing apoptosis (except when stimulated by the ligand netrin-1). Panel CNS_Neurodegeneration_V1.0 shows a moderate increase (1.5 to 2-fold) in the temporal cortex of the Alzheimer's disease brain when compared to non-demented elderly either with or without a high amyloid plaque load [this difference is apparent after scaling the RTQ-PCR data based upon overall RNA amount/quality, and is most apparent on Aq2263]. Thus NOV1 gene represents a protein that differentiates demented and non-demented elderly who have a severe amyloid plaque load, making it an excellent drug target in Alzheimer's disease. The modulation and/or selective stimulation of this receptor may be of use in enhancing or directing compensatory synatogenesis and axon/dendritic outgrowth in response to neuronal death (stroke, head trauma) neurodegeneration (Alzheimer's, Parkinson's, Huntington's, spinocerebellar ataxia, progressive supranuclear palsy) or spinal cord injury. Furthermore, antagonism of this receptor may decrease apoptosis in Alzheimer's disease.

References:

1. Ellezam B, Selles-Navarro I, Manitt C, Kennedy T E, McKerracher L. Expression of netrin-1 and its receptors DCC and UNC-5H2 after axotomy and during regeneration of adult rat retinal ganglion cells. Exp Neurol 2001 March; 168(1):105–15

Netrins are a family of chemotropic factors that guide axon outgrowth during development; however, their function in the adult CNS remains to be established. We examined the expression of the netrin receptors DCC and UNC5H2 in adult rat retinal ganglion cells (RGCs) after grafting a peripheral nerve (PN) to the transected optic nerve and following optic nerve transection alone. In situ hybridization revealed that both Dcc and Unc5h2 mRNAs are expressed by normal adult RGCs. In addition, netrin-1 was found to be constitutively expressed by RGCs. Quantitative analysis using in situ hybridization demonstrated that both Dcc and Unc5h2 were down-regulated by RGCs following axotomy. In the presence of an attached PN graft, Dcc and Unc5h2 were similarly down-regulated in surviving RGCs regardless of their success in regenerating an axon. Northern blot analysis demonstrated expression of netrin-1 in both optic and sciatic nerve, and Western blot analysis revealed the presence of netrin protein in both nerves. Immunohistochemical analysis indicated that netrin protein was closely associated with glial cells in the optic nerve. These results suggest that netrin-1, DCC, and UNC5H2 may contribute to regulating the regenerative capacity of adult RGCs.

2. Braisted J E, Catalano S M, Stimac R, Kennedy T E, Tessier-Lavigne M, Shatz C J, O'Leary D D Netrin-1 promotes thalamic axon growth and is required for proper development of the thalamocortical projection. J Neurosci 2001 Aug. 1;20(15):5792–801

The thalamocortical axon (TCA) projection originates in dorsal thalamus, conveys sensory input to the neocortex, and has a critical role in cortical development. We show that the secreted axon guidance molecule netrin-1 acts in vitro as an attractant and growth promoter for dorsal thalamic axons and is required for the proper development of the TCA projection in vivo. As TCAs approach the hypothalamus, they turn laterally into the ventral telencephalon and extend toward the cortex through a population of netrin-1-expressing cells. DCC and neogenin, receptors implicated in mediating the attractant effects of netrin-1, are expressed in dorsal thalamus, whereas unc5h2 and unc5h3, netrin-1 receptors implicated in repulsion, are not. In vitro, dorsal thalamic axons show biased growth toward a source of netrin-1, which can be abolished by netrin-1-blocking antibodies. Netrin-1 also enhances overall axon outgrowth from explants of dorsal thalamus. The biased growth of dorsal thalamic axons toward the internal capsule zone of ventral telencephalic explants is attenuated, but not significantly, by netrin-1-blocking antibodies, suggesting that it releases another attractant activity for TCAs in addition to netrin-1. Analyses of netrin-1 −/− mice reveal that the TCA projection through the ventral telencephalon is disorganized, their pathway is abnormally restricted, and fewer dorsal thalamic axons reach cortex. These findings demonstrate that netrin-1 promotes the growth of TCAs through the ventral telencephalon and cooperates with other guidance cues to control their pathfinding from dorsal thalamus to cortex.

Panel 1.2 Summary: Ag1522

Expression of a NOV1 gene is highest in CNS cancer cell lines (CT=26.1). Of nine tissue samples derived from CNS cancer cell lines, expression of a NOV1 gene occurs in all samples, with expression high in three samples, moderate in five samples and low in one sample. High expression is also detectable in melanoma cell lines. Significant expression of a NOV1 gene is seen in gastric cancer and all ten samples of lung cancer cell lines in this sample. Thus, expression of a NOV1 gene could be used to distinguish those cancer cell lines from normal tissues. In addition, therapeutic modulation of the expression, or activity of a NOV1 gene product, might be of use in the treatment of melanoma, gastric cancer, lung cancer and brain cancer.

Panel 1.3D Summary: Ag1522/Ag1848/Ag2263/Ag2422

Four experiments using different probe/primer sets on the same tissue panel produce results that are in excellent agreement. In all four experiments, highest expression of a NOV1 gene is detected in CNS cancer cell lines. Expression is also significant in lung cancer and melanoma cell lines and in healthy brain tissue from the hippocampus and thalamus regions. Thus, the expression of a NOV1 gene could be used to distinguish these tissue samples from other samples. Moreover, therapeutic modulation of the expression, or function, of the CG50126-01 gene, through the use of small molecule drugs or antibodies, might be beneficial in the treatment of melanoma, lung cancer and brain cancer.

Among metabolic tissues, there is high expression of a NOV1 gene in adult heart tissue (CT=27.8) and moderate expression in fetal heart, adult and fetal liver, pancreas, adrenal gland, thyroid and pituitary. This widespread expression of a NOV1 gene product in tissues with metabolic function suggests a possible role for a NOV1 gene product in metabolic disorders, including obesity and diabetes.

The UNC5H receptors act both in axon guidance and neuronal migration during development, as well as inducers of apoptosis (except when stimulated by the ligand netrin-1). This panel shows widespread expression of a NOV1 gene in the central nervous system. Please see CNS_neurodegeneration_v1.0 for discussion of potential utility in the central nervous system.

Panel 2D Summary: Ag1522/Ag1848/Ag2263/Ag2422

Results from multiple experiments with four different probe and primer sets are in very good agreement. In all four experiments, highest expression of a NOV1 gene is detected in thyroid and ovarian cancers (CTs=27–30), with lower expression also seen in most of the other tissues on this panel. Thus, the expression of a NOV1 gene could be used to distinguish ovarian and thyroid cancer cell lines from other tissues. Moreover, therapeutic modulation of the expression this gene, or its function, through the use of small molecule drugs or antibodies, might be of benefit in the treatment of ovarian and thyroid cancer. In addition, experiments with the probe and primer set Ag2263 show differential expression between samples derived from lung cancer and their adjacent normal tissues. Thus, expression of a NOV1 gene could be used to distinguish cancerous lung tissue from normal lung tissue. Moreover, therapeutic modulation of the expression or function of this gene or its protein product, through the use of antibodies or small molecule drugs, might be of benefit in the treatment of lung cancer.

Panel 3D Summary: Ag2263

Expression of a NOV1 gene occurs at moderate levels across all the tissues in this panel. Highest expression is detected in a small cell lung cancer (CT=30.6) and neuroblastoma (CT=30.7). In addition, significant expression is detected in a cluster of small cell lung cancer lines. Thus, this gene could be used to distinguish lung cancer cell lines from other samples. Moreover, therapeutic modulation of the CG50126-01 gene or its protein product, through the use of small molecule drugs or antibodies might be of benefit in the treatment of small cell lung cancer.

Panel 4D Summary: Ag1522/Ag1848/Ag2263/Ag2422

Experiments using each of the four probe and primer sets that correspond to a NOV1 gene produce results that are in excellent agreement. In all the experiments, expression of a NOV1 gene occurs at moderate to low levels in many of the tissues in the sample. Highest expression in each experiment occurs in lung fibroblasts (CT=29). Moderate expression in lung fibroblasts treated with IL-4 is also consistent among all four experiments (CT=30). Lower expression is also detected in a variety of fibroblasts, endothelial and smooth muscle cells. The expression of a NOV1 gene produces a complex profile; it is upregulated by TNF-alpha in small airway epithelium, but clearly downregulated by the same stimulus in lung fibroblasts. The gene most probably encodes a netrin receptor that may be important in understanding cell migration. Regulation of the protein encoded for by a NOV1 gene could potentially control the progression of keloid formation, emphysema and other conditions in which TNF-alpha and IL-1 beta are present and tissue remodeling may occur.

Panel CNS_1 Summary: Ag2263

Expression of NOV1 is moderate to low across many of the tissues in this panel. Highest expression is detected in the substantia nigra (CT=31.4). Although no disease-specific expression is seen in this panel, the expression profile confirms the expression of this gene in the central nervous system. Please see CNS_neurodegeneration_v1.0 for potential utility of the CG50126-01 gene regarding the CNS.

NOV2

Expression of gene CG50718-01 was assessed using the primer-probe sets Ag1555 and Ag2315, described in Tables 25 and 26. Results of the RTQ-PCR runs are shown in Tables 27, 28, 29 and 30.

TABLE 25

Probe Name Ag1555

| Primers | Sequences | Length | Start Position | SEQ ID NO: |
|---|---|---|---|---|
| Forward | 5'-gaagtgaaagaatgtgcatggt-3' | 22 | 6680 | 145 |
| Probe | TET-5'-caccagtgcattctggatctcttatca-3'-TAMRA | 27 | 6730 | 146 |
| Reverse | 5'-tgggctgattacttcccttatt-3' | 22 | 6757 | 147 |

TABLE 26

Probe Name Ag2315

| Primers | Sequences | Length | Start Position | SEQ ID NO: |
|---|---|---|---|---|
| Forward | 5'-agatgagtcagtgccgttagc-3' | 21 | 3711 | 148 |
| Probe | TET-5'-cctccacaaaatttgactttaatcaactg-3'-TAMRA | 29 | 3733 | 149 |
| Reverse | 5'-tccatttcagccatacaaagtc-3' | 22 | 3769 | 150 |

TABLE 27

Panel 1.3D

| Tissue Name | Rel. Exp. (%) Ag1555, Run 146380268 | Rel. Exp. (%) Ag1555, Run 147775028 | Rel. Exp. (%) Ag2315, Run 159198312 | Tissue Name | Rel. Exp. (%) Ag1555, Run 146380268 | Rel. Exp. (%) Ag1555, Run 147775028 | Rel. Exp. (%) Ag2315, Run 159198312 |
|---|---|---|---|---|---|---|---|
| Liver adenocarcinoma | 0.0 | 0.0 | 0.0 | Kidney (fetal) | 33.9 | 37.6 | 90.8 |
| Pancreas | 5.8 | 1.6 | 3.9 | Renal ca. 786-0 | 0.0 | 0.0 | 0.0 |
| Pancreatic ca. CAPAN 2 | 0.0 | 0.0 | 0.0 | Renal ca. A498 | 0.0 | 0.0 | 0.0 |
| Adrenal gland | 0.0 | 1.9 | 0.0 | Renal ca. RXF 393 | 0.0 | 0.0 | 0.0 |
| Thyroid | 8.3 | 24.7 | 25.3 | Renal ca. ACHN | 0.0 | 0.0 | 0.0 |
| Salivary gland | 1.0 | 0.0 | 0.0 | Renal ca. UO-31 | 0.0 | 1.4 | 0.0 |
| Pituitary gland | 0.0 | 0.0 | 8.0 | Renal ca. TK-10 | 0.0 | 0.0 | 0.0 |
| Brain (fetal) | 0.6 | 0.0 | 3.8 | Liver | 0.0 | 0.0 | 0.0 |
| Brain (whole) | 1.3 | 1.6 | 3.3 | Liver (fetal) | 0.0 | 3.6 | 0.0 |
| Brain (amygdala) | 3.4 | 4.0 | 6.7 | Liver ca. (hepatoblast) HepG2 | 0.0 | 0.0 | 0.0 |
| Brain (cerebellum) | 0.0 | 0.0 | 0.0 | Lung | 51.1 | 52.5 | 70.7 |
| Brain (hippocampus) | 1.2 | 0.6 | 5.9 | Lung (fetal) | 100.0 | 100.0 | 74.2 |
| Brain (substantia nigra) | 0.0 | 0.0 | 0.0 | Lung ca. (small cell) LX-1 | 0.0 | 0.0 | 0.0 |
| Brain (thalamus) | 3.2 | 1.3 | 4.0 | Lung ca. (small cell) NCI-H69 | 2.4 | 0.0 | 32.5 |
| Cerebral Cortex | 0.0 | 0.0 | 12.4 | Lung ca. (s. cell var.) SHP-77 | 0.0 | 0.0 | 10.7 |
| Spinal cord | 1.1 | 0.0 | 0.0 | Lung ca. (large cell) NCI-H460 | 0.0 | 0.0 | 0.0 |
| glio/astro U87-MG | 0.0 | 2.7 | 0.0 | Lung ca. (non-sm. cell) A549 | 0.0 | 0.0 | 0.0 |
| glio/astro U-118-MG | 27.2 | 34.6 | 15.8 | Lung ca. (non-s. cell) NCI-H23 | 0.0 | 0.0 | 0.0 |
| astrocytoma SW1783 | 5.4 | 13.8 | 16.0 | Lung ca. (non-s. cell) HOP-62 | 0.7 | 0.9 | 0.0 |
| neuro*; met SK-N-AS | 0.0 | 0.6 | 0.0 | Lung ca. (non-s. cl) NCI-H522 | 9.9 | 5.4 | 20.9 |
| astrocytoma SF-539 | 0.8 | 0.0 | 0.0 | Lung ca. (squam.) SW 900 | 0.0 | 0.0 | 0.0 |
| astrocytoma SNB-75 | 0.0 | 0.0 | 0.0 | Lung ca. (squam.) NCI-H596 | 1.3 | 2.2 | 9.0 |
| glioma SNB-19 | 0.0 | 0.0 | 0.0 | Mammary gland | 13.0 | 26.6 | 11.5 |

TABLE 27-continued

Panel 1.3D

| Tissue Name | Rel. Exp. (%) Ag1555, Run 146380268 | Rel. Exp. (%) Ag1555, Run 147775028 | Rel. Exp. (%) Ag2315, Run 159198312 | Tissue Name | Rel. Exp. (%) Ag1555, Run 146380268 | Rel. Exp. (%) Ag1555, Run 147775028 | Rel. Exp. (%) Ag2315, Run 159198312 |
|---|---|---|---|---|---|---|---|
| glioma U251 | 0.0 | 0.0 | 0.0 | Breast ca.* (pl. ef) MCF-7 | 3.9 | 0.9 | 15.6 |
| glioma SF-295 | 1.3 | 3.3 | 0.0 | Breast ca.* (pl. ef) MDA-MB-231 | 0.0 | 0.0 | 0.0 |
| Heart (Fetal) | 0.0 | 0.0 | 7.4 | Breast ca.* (pl. ef) T47D | 0.0 | 0.0 | 6.1 |
| Heart | 0.0 | 5.7 | 0.0 | Breast ca. BT-549 | 0.0 | 0.0 | 0.0 |
| Skeletal muscle (Fetal) | 3.5 | 1.6 | 15.1 | Breast ca. MDA-N | 0.0 | 0.0 | 0.0 |
| Skeletal muscle | 0.0 | 1.4 | 2.5 | Ovary | 5.2 | 1.6 | 5.8 |
| Bone marrow | 1.0 | 4.1 | 0.0 | Ovarian ca. OVCAR-3 | 0.0 | 0.0 | 6.7 |
| Thymus | 1.0 | 0.0 | 8.8 | Ovarian ca. OVCAR-4 | 0.0 | 0.0 | 0.0 |
| Spleen | 0.0 | 0.0 | 0.0 | Ovarian ca. OVCAR-5 | 0.0 | 0.0 | 0.0 |
| Lymph node | 3.7 | 4.8 | 7.1 | Ovarian ca. OVCAR-8 | 0.0 | 0.0 | 0.0 |
| Colorectal | 0.0 | 0.0 | 0.0 | Ovarian ca. IGROV-1 | 0.0 | 0.0 | 0.0 |
| Stomach | 1.2 | 2.3 | 0.0 | Ovarian ca. (ascites) SK-OV-3 | 0.0 | 0.0 | 0.0 |
| Small intestine | 2.2 | 6.7 | 0.0 | Uterus | 0.0 | 0.9 | 0.0 |
| Colon ca. SW480 | 0.0 | 0.0 | 0.0 | Placenta | 11.8 | 27.7 | 23.7 |
| Colon ca.* SW620 (SW480 met) | 0.0 | 0.0 | 0.0 | Prostate | 3.5 | 0.9 | 3.0 |
| Colon ca. HT29 | 0.0 | 0.0 | 0.0 | Prostate ca.* (bone met) PC-3 | 0.0 | 0.0 | 0.0 |
| Colon ca. HCT-116 | 0.0 | 0.0 | 2.7 | Testis | 58.2 | 67.4 | 21.5 |
| Colon ca. CaCo-2 | 0.0 | 0.0 | 0.0 | Melanoma Hs688(A).T | 22.7 | 52.1 | 18.2 |
| CC Well to Mod Diff (ODO3866) | 0.0 | 0.0 | 0.0 | Melanoma* (met) Hs688(B).T | 4.8 | 4.2 | 0.0 |
| Colon ca. HCC-2998 | 0.0 | 0.0 | 0.0 | Melanoma UACC-62 | 0.0 | 1.5 | 0.0 |
| Gastric ca. (liver met) NCI-N87 | 0.0 | 0.0 | 0.0 | Melanoma M14 | 0.0 | 0.0 | 0.0 |
| Bladder | 2.0 | 0.0 | 6.1 | Melanoma LOX IMVI | 0.0 | 0.0 | 0.0 |
| Trachea | 2.4 | 3.6 | 0.0 | Melanoma* (met) SK-MEL-5 | 0.0 | 0.0 | 0.0 |
| Kidney | 15.5 | 17.8 | 22.2 | Adipose | 38.2 | 40.6 | 100.0 |

TABLE 28

Panel 2D

| Tissue Name | Rel. Exp. (%) Ag1555, Run 147775063 | Rel. Exp. (%) Ag1555, Run 159601974 | Rel. Exp. (%) Ag2315, Run 159200827 | Tissue Name | Rel. Exp. (%) Ag1555, Run 147775063 | Rel. Exp. (%) Ag1555, Run 159601974 | Rel. Exp. (%) Ag2315, Run 159200827 |
|---|---|---|---|---|---|---|---|
| Normal Colon | 3.8 | 7.1 | 12.4 | Kidney Margin 8120608 | 2.9 | 1.2 | 1.7 |
| CC Well to Mod Diff (ODO3866) | 1.0 | 0.0 | 2.3 | Kidney Cancer 8120613 | 0.0 | 0.0 | 0.0 |
| CC Margin | 0.0 | 0.0 | 0.7 | Kidney | 1.2 | 2.6 | 1.8 |

TABLE 28-continued

Panel 2D

| Tissue Name | Rel. Exp. (%) Ag1555, Run 147775063 | Rel. Exp. (%) Ag1555, Run 159601974 | Rel. Exp. (%) Ag2315, Run 159200827 | Tissue Name | Rel. Exp. (%) Ag1555, Run 147775063 | Rel. Exp. (%) Ag1555, Run 159601974 | Rel. Exp. (%) Ag2315, Run 159200827 |
|---|---|---|---|---|---|---|---|
| (OD03866) | | | | Margin 8120614 | | | |
| CC Gr.2 rectosigmoid (OD03868) | 0.0 | 0.0 | 0.0 | Kidney Cancer 9010320 | 2.7 | 2.6 | 2.1 |
| CC Margin (OD03868) | 0.0 | 0.7 | 0.0 | Kidney Margin 9010321 | 6.6 | 5.9 | 4.9 |
| CC Mod Diff (OD03920) | 0.0 | 0.0 | 0.0 | Normal Uterus | 0.0 | 0.0 | 1.8 |
| CC Margin (OD03920) | 0.0 | 0.0 | 2.2 | Uterine Cancer 064011 | 0.0 | 0.0 | 4.5 |
| CC Gr.2 ascend colon (OD03921) | 0.0 | 0.0 | 0.0 | Normal Thyroid | 34.9 | 27.4 | 11.4 |
| CC Margin (OD03921) | 0.0 | 0.0 | 0.0 | Thyroid Cancer | 2.9 | 7.2 | 7.9 |
| CC from Partial Hepatectomy (OD04309)Mets | 1.6 | 1.1 | 0.0 | Thyroid Cancer A302152 | 1.3 | 3.3 | 2.0 |
| Liver Margin (OD04309) | 0.0 | 0.0 | 2.0 | Thyroid Margin A302153 | 49.7 | 69.7 | 72.2 |
| Colon mets to lung (OD04451-01) | 2.0 | 1.0 | 0.5 | Normal Breast | 10.0 | 8.9 | 25.3 |
| Lung Margin (OD04451-02) | 8.6 | 10.0 | 10.9 | Breast Cancer | 10.2 | 3.0 | 1.1 |
| Normal Prostate 6546-1 | 4.2 | 12.2 | 1.4 | Breast Cancer (OD04590-01) | 0.0 | 2.8 | 3.9 |
| Prostate Cancer (OD04410) | 0.0 | 0.0 | 3.4 | Breast Cancer Mets (OD04590-03) | 7.8 | 7.3 | 7.9 |
| Prostate Margin (OD04410) | 0.8 | 6.4 | 2.2 | Breast Cancer Metastasis | 4.1 | 8.0 | 3.5 |
| Prostate Cancer (OD04720-01) | 9.5 | 11.7 | 19.6 | Breast Cancer | 0.0 | 0.0 | 1.2 |
| Prostate Margin (OD04720-02) | 10.0 | 11.3 | 24.5 | Breast Cancer | 3.7 | 2.9 | 0.9 |
| Normal Lung | 59.9 | 61.1 | 87.7 | Breast Cancer 9100266 | 2.2 | 1.1 | 1.5 |
| Lung Met to Muscle (OD04286) | 0.0 | 0.0 | 0.0 | Breast Margin 9100265 | 0.0 | 0.0 | 0.5 |
| Muscle Margin (OD04286) | 0.9 | 0.0 | 1.8 | Breast Cancer A209073 | 0.7 | 1.1 | 1.9 |
| Lung Malignant Cancer (OD03126) | 1.9 | 2.8 | 1.7 | Breast Margin A2090734 | 0.0 | 1.2 | 0.9 |
| Lung Margin (OD03126) | 36.3 | 35.6 | 43.8 | Normal Liver | 0.0 | 0.0 | 0.0 |
| Lung Cancer (OD04404) | 2.2 | 4.4 | 4.3 | Liver Cancer | 0.0 | 0.0 | 0.6 |
| Lung Margin (OD04404) | 9.5 | 4.2 | 8.4 | Liver Cancer 1025 | 0.0 | 0.0 | 0.0 |

TABLE 28-continued

Panel 2D

| Tissue Name | Rel. Exp. (%) Ag1555, Run 147775063 | Rel. Exp. (%) Ag1555, Run 159601974 | Rel. Exp. (%) Ag2315, Run 159200827 | Tissue Name | Rel. Exp. (%) Ag1555, Run 147775063 | Rel. Exp. (%) Ag1555, Run 159601974 | Rel. Exp. (%) Ag2315, Run 159200827 |
|---|---|---|---|---|---|---|---|
| Lung Cancer (OD04565) | 0.0 | 0.0 | 0.0 | Liver Cancer 1026 | 0.0 | 0.0 | 0.0 |
| Lung Margin (OD04565) | 10.8 | 9.7 | 14.1 | Liver Cancer 6004-T | 0.0 | 1.0 | 0.6 |
| Lung Cancer (OD04237-01) | 0.0 | 0.0 | 0.0 | Liver Tissue 6004-N | 0.0 | 0.0 | 0.0 |
| Lung Margin (OD04237-02) | 30.1 | 18.4 | 29.3 | Liver Cancer 6005-T | 0.0 | 0.0 | 0.0 |
| Ocular Mel Met to Liver (ODO4310) | 0.0 | 0.0 | 0.6 | Liver Tissue 6005-N | 0.0 | 0.0 | 0.0 |
| Liver Margin (ODO4310) | 1.0 | 2.0 | 0.0 | Normal Bladder | 4.7 | 2.2 | 2.9 |
| Melanoma Metastasis | 0.0 | 0.0 | 0.0 | Bladder Cancer | 0.0 | 0.0 | 0.0 |
| Lung Margin (OD04321) | 25.7 | 47.0 | 49.0 | Bladder Cancer | 0.0 | 4.2 | 5.5 |
| Normal Kidney | 86.5 | 100.0 | 100.0 | Bladder Cancer (OD04718-01) | 0.7 | 1.6 | 1.1 |
| Kidney Ca, Nuclear grade 2 (OD04338) | 2.2 | 0.0 | 1.1 | Bladder Normal Adjacent (OD04718-03) | 4.4 | 0.9 | 6.3 |
| Kidney Margin (OD04338) | 55.1 | 35.8 | 58.2 | Normal Ovary | 1.7 | 0.0 | 0.9 |
| Kidney Ca Nuclear grade 1/2 (OD04339) | 0.0 | 0.0 | 0.0 | Ovarian Cancer | 0.0 | 4.2 | 3.3 |
| Kidney Margin (OD04339) | 77.9 | 63.7 | 77.9 | Ovarian Cancer (OD04768-07) | 0.0 | 0.0 | 0.0 |
| Kidney Ca, Clear cell type (OD04340) | 1.7 | 0.0 | 0.0 | Ovary Margin (OD04768-08) | 9.4 | 5.5 | 6.9 |
| Kidney Margin (OD04340) | 100.0 | 53.2 | 62.4 | Normal Stomach | 0.0 | 0.0 | 0.0 |
| Kidney Ca, Nuclear grade 3 (OD04348) | 25.9 | 23.2 | 0.0 | Gastric Cancer 9060358 | 0.0 | 0.0 | 1.5 |
| Kidney Margin (OD04348) | 40.9 | 50.3 | 54.7 | Stomach Margin 9060359 | 0.0 | 0.0 | 2.0 |
| Kidney Cancer (OD04622-01) | 0.6 | 0.0 | 0.0 | Gastric Cancer 9060395 | 0.9 | 1.2 | 1.8 |
| Kidney Margin (OD04622-03) | 0.0 | 0.0 | 1.4 | Stomach Margin 9060394 | 0.0 | 1.0 | 0.7 |
| Kidney Cancer (OD04450-01) | 0.0 | 0.0 | 0.0 | Gastric Cancer 9060397 | 0.0 | 0.0 | 0.0 |
| Kidney Margin (OD04450-03) | 40.3 | 51.1 | 50.7 | Stomach Margin 9060396 | 0.0 | 0.0 | 0.0 |

TABLE 28-continued

Panel 2D

| Tissue Name | Rel. Exp. (%) Ag1555, Run 147775063 | Rel. Exp. (%) Ag1555, Run 159601974 | Rel. Exp. (%) Ag2315, Run 159200827 | Tissue Name | Rel. Exp. (%) Ag1555, Run 147775063 | Rel. Exp. (%) Ag1555, Run 159601974 | Rel. Exp. (%) Ag2315, Run 159200827 |
|---|---|---|---|---|---|---|---|
| Kidney Cancer 8120607 | 0.0 | 0.0 | 0.0 | Gastric Cancer 064005 | 0.0 | 0.0 | 2.5 |

TABLE 29

Panel 4D

| Tissue Name | Rel. Exp. (%) Ag1555, Run 147775116 | Rel. Exp. (%) Ag2315, Run 159202089 | Tissue Name | Rel. Exp. (%) Ag1555, Run 147775116 | Rel. Ex. (%) Ag2315, Run 159202089 |
|---|---|---|---|---|---|
| Secondary Th1 act | 0.0 | 0.0 | HUVEC IL-1beta | 0.0 | 0.0 |
| Secondary Th2 act | 0.0 | 0.0 | HUVEC IFN gamma | 0.0 | 0.0 |
| Secondary Tr1 act | 0.0 | 0.7 | HUVEC TNF alpha + IFN gamma | 0.0 | 0.0 |
| Secondary Th1 rest | 0.0 | 0.0 | HUVEC TNF alpha + IL4 | 0.0 | 0.0 |
| Secondary Th2 rest | 0.0 | 0.0 | HUVEC IL-11 | 0.0 | 0.0 |
| Secondary Tr1 rest | 0.0 | 0.0 | Lung Microvascular EC none | 0.0 | 0.0 |
| Primary Th1 act | 0.0 | 0.0 | Lung Microvascular EC TNFalpha + IL-1beta | 0.0 | 0.0 |
| Primary Th2 act | 0.0 | 0.0 | Microvascular Dermal EC none | 0.0 | 0.0 |
| Primary Tr1 act | 0.0 | 0.0 | Microsvascular Dermal EC TNFalpha + IL-1beta | 0.0 | 0.0 |
| Primary Th1 rest | 0.0 | 0.0 | Bronchial epithelium TNFalpha + IL1beta | 0.0 | 0.0 |
| Primary Th2 rest | 0.0 | 0.0 | Small airway epithelium none | 0.0 | 0.0 |
| Primary Tr1 rest | 0.0 | 0.0 | Small airway epithelium TNFalpha + IL-1beta | 0.0 | 0.0 |
| CD45RA CD4 lymphocyte act | 3.3 | 5.0 | Coronery artery SMC rest | 1.0 | 2.3 |
| CD45RO CD4 lymphocyte act | 0.0 | 0.0 | Coronery artery SMC TNFalpha + IL-1beta | 3.7 | 1.2 |
| CD8 lymphocyte act | 0.0 | 0.0 | Astrocytes rest | 3.2 | 0.5 |
| Secondary CD8 lymphocyte rest | 0.0 | 0.0 | Astrocytes TNFalpha + IL-1beta | 1.0 | 1.5 |
| Secondary CD8 lymphocyte act | 0.0 | 0.0 | KU-812 (Basophil) rest | 0.0 | 0.0 |
| CD4 lymphocyte none | 0.0 | 0.0 | KU-812 (Basophil) PMA/ionomycin | 0.0 | 0.0 |
| 2ry Th1/Th2/Tr1_anti-CD95 CH11 | 0.0 | 0.0 | CCD1106 (Keratinocytes) none | 0.0 | 0.0 |
| LAK cells rest | 0.0 | 0.0 | CCD1106 (Keratinocytes) TNFalpha + IL-1beta | 0.0 | 0.0 |
| LAK cells IL-2 | 0.0 | 0.0 | Liver cirrhosis | 1.4 | 3.8 |
| LAK cells IL-2 + IL-12 | 0.0 | 0.0 | Lupus kidney | 0.0 | 0.8 |
| LAK cells IL-2 + IFN gamma | 0.0 | 0.0 | NCI-H292 none | 0.0 | 0.0 |
| LAK cells IL-2 + IL-18 | 0.0 | 0.0 | NCI-H292 IL-4 | 0.0 | 2.3 |
| LAK cells PMA/ionomycin | 0.0 | 0.0 | NCI-H292 IL-9 | 0.0 | 0.5 |

TABLE 29-continued

Panel 4D

| Tissue Name | Rel. Exp. (%) Ag1555, Run 147775116 | Rel. Exp. (%) Ag2315, Run 159202089 | Tissue Name | Rel. Exp. (%) Ag1555, Run 147775116 | Rel. Ex. (%) Ag2315, Run 159202089 |
|---|---|---|---|---|---|
| NK Cells IL-2 rest | 0.0 | 0.0 | NCI-H292 IL-13 | 0.0 | 1.3 |
| Two Way MLR 3 day | 0.0 | 0.0 | NCI-H292 IFN gamma | 0.0 | 0.0 |
| Two Way MLR 5 day | 0.0 | 0.0 | HPAEC none | 0.0 | 0.0 |
| Two Way MLR 7 day | 0.0 | 0.0 | HPAEC TNF alpha + IL-1 beta | 0.0 | 0.0 |
| PBMC rest | 0.0 | 0.0 | Lung fibroblast none | 0.0 | 0.9 |
| PBMC PWM | 0.0 | 0.0 | Lung fibroblast TNF alpha + IL-1 beta | 0.0 | 0.0 |
| PBMC PHA-L | 0.0 | 0.0 | Lung fibroblast IL-4 | 0.0 | 0.0 |
| Ramos (B cell) none | 0.0 | 0.0 | Lung fibroblast IL-9 | 5.7 | 1.3 |
| Ramos (B cell) ionomycin | 0.0 | 0.0 | Lung fibroblast IL-13 | 1.5 | 1.5 |
| B lymphocytes PWM | 0.0 | 0.0 | Lung fibroblast IFN gamma | 0.0 | 1.7 |
| B lymphocytes CD40L and IL-4 | 0.0 | 0.0 | Dermal fibroblast CCD1070 rest | 12.9 | 17.2 |
| EOL-1 dbcAMP | 0.0 | 0.0 | Dermal fibroblast CCD1070 TNF alpha | 18.6 | 12.0 |
| EOL-1 dbcAMP PMA/ionomycin | 0.0 | 0.0 | Dermal fibroblast CCD1070 IL-1 beta | 6.1 | 2.9 |
| Dendritic cells none | 0.0 | 0.0 | Dermal fibroblast IFN gamma | 0.0 | 0.0 |
| Dendritic cells LPS | 0.0 | 0.0 | Dermal fibroblast IL-4 | 1.4 | 0.6 |
| Dendritic cells anti-CD40 | 0.0 | 0.0 | IBD Colitis 2 | 0.0 | 1.4 |
| Monocytes rest | 0.0 | 0.0 | IBD Crohn's | 0.0 | 0.0 |
| Monocytes LPS | 0.0 | 0.0 | Colon | 0.6 | 0.0 |
| Macrophages rest | 0.0 | 0.0 | Lung | 4.0 | 11.7 |
| Macrophages LPS | 0.0 | 0.0 | Thymus | 100.0 | 100.0 |
| HUVEC none | 0.0 | 0.0 | Kidney | 4.2 | 5.3 |
| HUVEC starved | 0.0 | 0.0 | | | |

TABLE 30

Panel 5D

| Tissue Name | Rel. Exp. (%) Ag2315, Run 169275446 | Tissue Name | Rel. Exp. (%) Ag2315, Run 169275446 |
|---|---|---|---|
| 97457_Patient-02go_adipose | 84.1 | 94709_Donor 2 AM - A_adipose | 13.6 |
| 97476_Patient-07sk_skeletal muscle | 0.6 | 94710_Donor 2 AM - B_adipose | 9.3 |
| 97477_Patient-07ut_uterus | 0.0 | 94711_Donor 2 AM - C_adipose | 3.6 |
| 97478_Patient-07pl_placenta | 7.2 | 94712_Donor 2 AD - A_adipose | 8.7 |
| 97481_Patient-08sk_skeletal muscle | 4.4 | 94713_Donor 2 AD - B_adipose | 17.1 |
| 97482_Patient-08ut_uterus | 0.5 | 94714_Donor 2 AD - C_adipose | 21.6 |
| 97483_Patient-08pl_placenta | 6.5 | 94742_Donor 3 U - A_Mesenchymal Stem Cells | 9.0 |
| 97486_Patient-09sk_skeletal muscle | 0.0 | 94743_Donor 3 U - B_Mesenchymal Stem Cells | 7.3 |
| 97487_Patient-09ut_uterus | 0.5 | 94730_Donor 3 AM - A_adipose | 14.8 |
| 97488_Patient-09pl_placenta | 6.1 | 94731_Donor 3 AM - B_adipose | 13.9 |
| 97492_Patient-10ut_uterus | 0.0 | 94732_Donor 3 AM - C_adipose | 5.9 |

TABLE 30-continued

Panel 5D

| Tissue Name | Rel. Exp. (%) Ag2315, Run 169275446 | Tissue Name | Rel. Exp. (%) Ag2315, Run 169275446 |
|---|---|---|---|
| 97493_Patient-10pl_placenta | 7.8 | 94733_Donor 3 AD - A_adipose | 5.4 |
| 97495_Patient-11go_adipose | 100.0 | 94734_Donor 3 AD - B_adipose | 4.7 |
| 97496_Patient-11sk_skeletal muscle | 0.6 | 94735_Donor 3 AD - C_adipose | 9.3 |
| 97497_Patient-11ut_uterus | 1.0 | 77138_Liver_HepG2untreated | 6.9 |
| 97498_Patient-11pl_placenta | 7.3 | 73556_Heart_Cardiac stromal cells (primary) | 0.0 |
| 97500_Patient-12go_adipose | 61.6 | 81735_Small Intestine | 1.5 |
| 97501_Patient-12sk_skeletal muscle | 3.2 | 72409_Kidney_Proximal Convoluted Tubule | 0.0 |
| 97502_Patient-12ut_uterus | 1.4 | 82685_Small intestine_Duodenum | 0.0 |
| 97503_Patient-12pl_placenta | 1.5 | 90650_Adrenal_Adrenocortical adenoma | 0.0 |
| 94721_Donor 2 U - A_Mesenchymal Stem Cells | 14.4 | 72410_Kidney_HRCE | 0.0 |
| 94722_Donor 2 U - B_Mesenchymal Stem Cells | 6.7 | 72411_Kidney_HRE | 0.0 |
| 94723_Donor 2 U - C Mesenchymal Stem Cells | 6.0 | 73139_Uterus_Uterine smooth muscle cells | 0.0 |

Panel 1.3D Summary: Ag1555/2315 Highest expression of the CG50718-01 gene is seen in adipose and the fetal lung (CTs=31.8–34.4). Results from three experiments with two different probe and primer sets produce similar expression profiles. Low but significant expression is also seen in the thyroid. Biologic cross-talk between the thyroid and adipose tissue is believed to be a component of some forms of obesity. Thus, the CG50718-01 gene product may be an important small molecule target for the treatment of obesity or other metabolic disorders.

In addition, the CG50718-01 gene appears to be expressed at significant levels in lung and kidney tissues from both fetal and adult sources, but not in any samples derived from lung or kidney cancer cell lines. Thus, expression of this gene could potentially be used to differentiate between normal lung and kidney tissue and lung and kidney cancer. Furthermore, therapeutic modulation of the CG50718-01 gene product may be beneficial in the treatment of lung and kidney cancers.

Please note that two other experiments with the probe and primer set Ag2315 had low/undetectable levels of expression in all the samples on this panel. (Data not shown.)

Panel 2D Summary: Ag1555/2315 Three experiments with two different probe and primer sets produce results that are in excellent agreement with highest expression of the CG50718-01 gene in normal kidney tissue (CTs=30.7–32.4). There are also significant levels of expression in samples derived from normal lung tissue, a result that is in concordance with the expression seen in Panel 1.3D. This gene appears to be preferentially expressed in healthy tissue, when compared to adjacent cancerous tissue. Thus, expression of the CG50718-01 gene could be used to distinguish normal kideny and lung tissue from malignant kidney and lung tissue. Moreover, therapeutic modulation of this gene, through small molecule drugs, antibodies or protein therapeutics might be of benefit in the treatment of kidney cancer and lung cancer.

Panel 3D Summary: Ag2315 Expression is low/undetectable in all the samples in this panel (CT>35). (Data not shown.)

Panel 4D Summary: Ag1555/Ag2315 The CG50718-01 transcript is detected at significant levels in the thymus (CT 31.48) and at lower levels in dermal fibroblasts (CT 33.91). This transcript encodes a protein that could potentially serve as a marker for thymus tissue and may also be involved in skin homeostasis. Therapeutics designed with the protein encoded by the CG50718-01 transcript could be important for maintaining or restoring normal function to these organs during inflammation.

Panel 5D Summary: Ag2315 is modestly expressed (CT values 31–34) in human adipose tissue and in cultured human adipocytes. This expression is in agreement with the significant levels of expression in adipose detected in Panel 1.3D. Thus, this gene product may be a small molecule target for the treatment of obesity.

NOV3

Expression of NOV3 was assessed using the primer-probe set Ag2304, described in Table 31. Results of the RTQ-PCR runs are shown in Tables 32, 33, 34 and 35.

TABLE 31

Probe Name Ag2304

| Primers | Sequences | Length | Start Position | SEQ ID NO: |
|---|---|---|---|---|
| Forward | 5'-accttaagtcctgccaacaatt-3' | 22 | 4100 | 151 |
| Probe | TET-5'-ttacagagtccaaattgtggatccca-3'-TAMRA | 26 | 4147 | 152 |
| Reverse | 5'-tgatcccttccagaatttgac-3' | 21 | 4173 | 153 |

TABLE 32

CNS_neurodegeneration_v1.0

| Tissue Name | Rel. Exp. (%) Ag2304, Run 206262286 | Tissue Name | Rel. Exp. (%) Ag2304, Run 206262286 |
|---|---|---|---|
| AD 1 Hippo | 0.0 | Control (Path) 3 Temporal Ctx | 7.3 |
| AD 2 Hippo | 38.4 | Control (Path) 4 Temporal Ctx | 29.5 |
| AD 3 Hippo | 8.5 | AD 1 Occipital Ctx | 16.5 |
| AD 4 Hippo | 9.5 | AD 2 Occipital Ctx (Missing) | 0.0 |
| AD 5 Hippo | 100.0 | AD 3 Occipital Ctx | 8.7 |
| AD 6 Hippo | 70.7 | AD 4 Occipital Ctx | 22.2 |
| Control 2 Hippo | 44.8 | AD 5 Occipital Ctx | 45.1 |
| Control 4 Hippo | 13.3 | AD 5 Occipital Ctx | 0.0 |
| Control (Path) 3 Hippo | 0.0 | Control 1 Occipital Ctx | 4.5 |
| AD 1 Temporal Ctx | 25.0 | Control 2 Occipital Ctx | 58.2 |
| AD 2 Temporal Ctx | 39.2 | Control 3 Occipital Ctx | 18.2 |
| AD 3 Temporal Ctx | 7.7 | Control 4 Occipital Ctx | 7.3 |
| AD 4 Temporal Ctx | 0.2 | Control (Path) 1 Occipital Ctx | 92.7 |
| AD 5 Inf Temporal Ctx | 76.8 | Control (Path) 2 Occipital Ctx | 0.0 |
| AD 5 Sup Temporal Ctx | 40.6 | Control (Path) 3 Occipital Ctx | 3.4 |
| AD 6 Inf Temporal Ctx | 49.7 | Control (Path) 4 Occipital Ctx | 16.7 |
| AD 6 Sup Temporal Ctx | 57.4 | Control 1 Parietal Ctx | 7.1 |
| Control 1 Temporal Ctx | 9.2 | Control 2 Parietal Ctx | 41.8 |
| Control 2 Temporal Ctx | 40.9 | Control 3 Parietal Ctx | 0.0 |
| Control 3 Temporal Ctx | 20.6 | Control (Path) 1 Parietal Ctx | 97.9 |
| Control 3 Temporal Ctx | 10.7 | Control (Path) 2 Parietal Ctx | 29.5 |
| Control (Path) 1 Temporal Ctx | 97.3 | Control (Path) 3 Parietal Ctx | 4.4 |
| Control (Path) 2 Temporal Ctx | 52.9 | Control (Path) 4 Parietal Ctx | 68.3 |

TABLE 33

Panel 1.3D

| Tissue Name | Rel. Exp. (%) Ag2304, Run 159131830 | Tissue Name | Rel. Exp. (%) Ag2304, Run 159131830 |
|---|---|---|---|
| Liver adenocarcinoma | 6.0 | Kidney (fetal) | 8.5 |
| Pancreas | 1.7 | Renal ca. 786-0 | 7.6 |
| Pancreatic ca. CAPAN 2 | 2.4 | Renal ca. A498 | 13.2 |
| Adrenal gland | 14.9 | Renal ca. RXF 393 | 3.2 |
| Thyroid | 6.5 | Renal ca. ACHN | 3.1 |
| Salivary gland | 2.3 | Renal ca. UO-31 | 8.3 |
| Pituitary gland | 13.4 | Renal ca. TK-10 | 3.5 |
| Brain (fetal) | 7.7 | Liver | 2.8 |
| Brain (whole) | 13.5 | Liver (fetal) | 5.8 |
| Brain (amygdala) | 15.5 | Liver ca. (hepatoblast) HepG2 | 7.3 |
| Brain (cerebellum) | 4.6 | Lung | 19.9 |
| Brain (hippocampus) | 100.0 | Lung (fetal) | 9.9 |
| Brain (substantia nigra) | 2.8 | Lung ca. (small cell) LX-1 | 5.4 |
| Brain (thalamus) | 10.0 | Lung ca. (small cell) NCI-H69 | 12.3 |
| Cerebral Cortex | 25.0 | Lung ca. (s. cell var.) SHP-77 | 12.1 |
| Spinal cord | 4.0 | Lung ca. (large cell) NCI-H460 | 3.8 |
| glio/astro U87-MG | 21.9 | Lung ca. (non-sm. cell) A549 | 5.9 |
| glio/astro U-118-MG | 40.9 | Lung ca. (non-s. cell) NCI-H23 | 13.6 |
| astrocytoma SW1783 | 9.2 | Lung ca. (non-s. cell) HOP-62 | 7.0 |
| neuro*; met SK-N-AS | 65.5 | Lung ca. (non-s. cl) NCI-H522 | 3.4 |
| astrocytoma SF-539 | 9.8 | Lung ca. (squam.) SW 900 | 6.6 |
| astrocytoma SNB-75 | 11.9 | Lung ca. (squam.) NCI-H596 | 1.7 |

TABLE 33-continued

Panel 1.3D

| Tissue Name | Rel. Exp. (%) Ag2304, Run 159131830 | Tissue Name | Rel. Exp. (%) Ag2304, Run 159131830 |
|---|---|---|---|
| glioma SNB-19 | 9.6 | Mammary gland | 18.4 |
| glioma U251 | 6.0 | Breast ca.* (pl. ef) MCF-7 | 6.3 |
| glioma SF-295 | 6.5 | Breast ca.* (pl. ef) MDA-MB-231 | 34.6 |
| Heart (Fetal) | 0.6 | Breast ca.* (pl. ef) T47D | 5.1 |
| Heart | 2.3 | Breast ca. BT-549 | 20.2 |
| Skeletal muscle (Fetal) | 11.4 | Breast ca. MDA-N | 5.7 |
| Skeletal muscle | 8.5 | Ovary | 5.6 |
| Bone marrow | 8.5 | Ovarian ca. OVCAR-3 | 7.7 |
| Thymus | 7.4 | Ovarian ca. OVCAR-4 | 0.7 |
| Spleen | 12.0 | Ovarian ca. OVCAR-5 | 16.7 |
| Lymph node | 6.3 | Ovarian ca. OVCAR-8 | 8.6 |
| Colorectal | 4.6 | Ovarian ca. IGROV-1 | 2.4 |
| Stomach | 8.5 | Ovarian ca. (ascites) SK-OV-3 | 15.5 |
| Small intestine | 9.2 | Uterus | 6.4 |
| Colon ca. SW480 | 8.0 | Placenta | 8.1 |
| Colon ca.* SW620 (SW480 met) | 5.3 | Prostate | 3.4 |
| Colon ca. HT29 | 2.6 | Prostate ca.* (bone met) PC-3 | 5.9 |
| Colon ca. HCT-116 | 7.4 | Testis | 18.6 |
| Colon ca. CaCo-2 | 7.4 | Melanoma Hs688(A).T | 4.5 |
| CC Well to Mod Diff (ODO3866) | 9.2 | Melanoma* (met) Hs688(B).T | 2.5 |
| Colon ca. HCC-2998 | 8.6 | Melanoma UACC-62 | 1.6 |
| Gastric ca. (liver met) NCI-N87 | 30.8 | Melanoma M14 | 0.6 |
| Bladder | 2.7 | Melanoma LOX IMVI | 4.0 |
| Trachea | 12.0 | Melanoma* (met) SK-MEL-5 | 2.3 |
| Kidney | 3.5 | Adipose | 7.5 |

TABLE 34

Panel 2D

| Tissue Name | Rel. Exp. (%) Ag2304, Run 159134494 | Tissue Name | Rel. Exp. (%) Ag2304, Run 159134494 |
|---|---|---|---|
| Normal Colon | 82.9 | Kidney Margin 8120608 | 5.5 |
| CC Well to Mod Diff (ODO3866) | 21.3 | Kidney Cancer 8120613 | 17.9 |
| CC Margin (ODO3866) | 14.6 | Kidney Margin 8120614 | 13.1 |
| CC Gr.2 rectosigmoid (ODO3868) | 10.9 | Kidney Cancer 9010320 | 24.7 |
| CC Margin (ODO3868) | 9.9 | Kidney Margin 9010321 | 19.3 |
| CC Mod Diff (ODO3920) | 21.5 | Normal Uterus | 17.6 |
| CC Margin (ODO3920) | 27.4 | Uterine Cancer 064011 | 52.5 |
| CC Gr.2 ascend colon (ODO3921) | 45.1 | Normal Thyroid | 22.7 |
| CC Margin (ODO3921) | 15.8 | Thyroid Cancer | 36.1 |
| CC from Partial Hepatectomy (ODO4309) Mets | 37.9 | Thyroid Cancer A302152 | 18.2 |
| Liver Margin (ODO4309) | 28.9 | Thyroid Margin A302153 | 30.1 |
| Colon mets to lung (OD04451-01) | 23.2 | Normal Breast | 49.7 |
| Lung Margin (OD04451-02) | 24.1 | Breast Cancer | 28.5 |

TABLE 34-continued

Panel 2D

| Tissue Name | Rel. Exp. (%) Ag2304, Run 159134494 | Tissue Name | Rel. Exp. (%) Ag2304, Run 159134494 |
|---|---|---|---|
| Normal Prostate 6546-1 | 18.4 | Breast Cancer (OD04590-01) | 51.8 |
| Prostate Cancer (OD04410) | 59.9 | Breast Cancer Mets (OD04590-03) | 64.6 |
| Prostate Margin (OD04410) | 67.4 | Breast Cancer Metastasis | 47.6 |
| Prostate Cancer (OD04720-01) | 46.7 | Breast Cancer | 26.2 |
| Prostate Margin (OD04720-02) | 93.3 | Breast Cancer | 28.9 |
| Normal Lung | 100.0 | Breast Cancer 9100266 | 20.2 |
| Lung Met to Muscle (ODO4286) | 41.2 | Breast Margin 9100265 | 16.7 |
| Muscle Margin (OD04286) | 47.6 | Breast Cancer A209073 | 38.2 |
| Lung Malignant Cancer (OD03126) | 31.9 | Breast Margin A2090734 | 44.8 |
| Lung Margin (OD03126) | 64.2 | Normal Liver | 23.2 |
| Lung Cancer (OD04404) | 58.6 | Liver Cancer | 23.3 |
| Lung Margin (OD04404) | 38.2 | Liver Cancer 1025 | 10.5 |
| Lung Cancer (OD04565) | 15.8 | Liver Cancer 1026 | 6.7 |
| Lung Margin (OD04565) | 26.4 | Liver Cancer 6004-T | 14.1 |
| Lung Cancer (OD04237-01) | 37.6 | Liver Tissue 6004-N | 9.5 |
| Lung Margin (OD04237-02) | 48.0 | Liver Cancer 6005-T | 6.7 |
| Ocular Mel Met to Liver (ODO4310) | 14.9 | Liver Tissue 6005-N | 6.7 |
| Liver Margin (ODO4310) | 13.5 | Normal Bladder | 49.0 |
| Melanoma Metastasis | 36.6 | Bladder Cancer | 5.7 |
| Lung Margin (OD04321) | 50.3 | Bladder Cancer | 32.5 |
| Normal Kidney | 84.7 | Bladder Cancer (OD04718-01) | 52.1 |
| Kidney Ca, Nuclear grade 2 (OD04338) | 65.1 | Bladder Normal Adjacent (OD04718-03) | 63.7 |
| Kidney Margin (OD04338) | 46.3 | Normal Ovary | 6.0 |
| Kidney Ca Nuclear grade 1/2 (OD04339) | 33.4 | Ovarian Cancer | 63.3 |
| Kidney Margin (OD04339) | 77.9 | Ovarian Cancer (OD04768-07) | 43.8 |
| Kidney Ca, Clear cell type (OD04340) | 71.7 | Ovary Margin (OD04768-08) | 14.6 |
| Kidney Margin (OD04340) | 57.0 | Normal Stomach | 30.4 |
| Kidney Ca, Nuclear grade 3 (OD04348) | 17.2 | Gastric Cancer 9060358 | 10.4 |
| Kidney Margin (OD04348) | 28.9 | Stomach Margin 9060359 | 12.9 |
| Kidney Cancer (OD04622-01) | 21.9 | Gastric Cancer 9060395 | 56.3 |
| Kidney Margin (OD04622-03) | 4.3 | Stomach Margin 9060394 | 30.4 |
| Kidney Cancer (OD04450-01) | 29.5 | Gastric Cancer 9060397 | 33.2 |
| Kidney Margin (OD04450-03) | 36.9 | Stomach Margin 9060396 | 8.9 |
| Kidney Cancer 8120607 | 3.4 | Gastric Cancer 064005 | 53.6 |

TABLE 35

Panel 4D

| Tissue Name | Rel. Exp. (%) Ag2304, Run 159131012 | Tissue Name | Rel. Exp. (%) Ag2304, Run 159131012 |
|---|---|---|---|
| Secondary Th1 act | 32.5 | HUVEC IL-1beta | 5.8 |
| Secondary Th2 act | 46.7 | HUVEC IFN gamma | 19.6 |
| Secondary Tr1 act | 47.0 | HUVEC TNF alpha + IFN gamma | 12.2 |
| Secondary Th1 rest | 14.5 | HUVEC TNF alpha + IL4 | 9.8 |
| Secondary Th2 rest | 27.0 | HUVEC IL-11 | 8.8 |
| Secondary Tr1 rest | 23.5 | Lung Microvascular EC none | 5.8 |
| Primary Th1 act | 44.1 | Lung Microvascular EC TNFalpha + IL-1beta | 12.8 |

TABLE 35-continued

Panel 4D

| Tissue Name | Rel. Exp. (%) Ag2304, Run 159131012 | Tissue Name | Rel. Exp. (%) Ag2304, Run 159131012 |
|---|---|---|---|
| Primary Th2 act | 39.2 | Microvascular Dermal EC none | 20.6 |
| Primary Tr1 act | 49.3 | Microsvasular Dermal EC TNFalpha + IL-1 beta | 16.0 |
| Primary Th1 rest | 95.3 | Bronchial epithelium TNFalpha + IL1beta | 14.2 |
| Primary Th2 rest | 54.7 | Small airway epithelium none | 7.9 |
| Primary Tr1 rest | 29.5 | Small airway epithelium TNFalpha + IL-1 beta | 38.4 |
| CD45RA CD4 lymphocyte act | 21.5 | Coronery artery SMC rest | 25.3 |
| CD45RO CD4 lymphocyte act | 37.1 | Coronery artery SMC TNFalpha + IL-1beta | 12.7 |
| CD8 lymphocyte act | 20.9 | Astrocytes rest | 23.0 |
| Secondary CD8 lymphocyte rest | 29.1 | Astrocytes TNFalpha + IL-1beta | 23.7 |
| Secondary CD8 lymphocyte act | 22.7 | KU-812 (Basophil) rest | 4.6 |
| CD4 lymphocyte none | 26.6 | KU-812 (Basophil) PMA/ionomycin | 11.0 |
| 2ry Th1/Th2/Tr1_anti-CD95 CH11 | 34.2 | CCD1106 (Keratinocytes) none | 15.8 |
| LAK cells rest | 41.5 | CCD1106 (Keratinocytes) TNFalpha + IL-1beta | 5.1 |
| LAK cells IL-2 | 33.2 | Liver cirrhosis | 2.8 |
| LAK cells IL-2 + IL-12 | 22.8 | Lupus kidney | 4.3 |
| LAK cells IL-2 + IFN gamma | 36.9 | NCI-H292 none | 34.9 |
| LAK cells IL-2 + IL-18 | 38.4 | NCI-H292 IL-4 | 38.4 |
| LAK cells PMA/ionomycin | 34.2 | NCI-H292 IL-9 | 39.2 |
| NK Cells IL-2 rest | 26.6 | NCI-H292 IL-13 | 21.2 |
| Two Way MLR 3 day | 53.2 | NCI-H292 IFN gamma | 20.9 |
| Two Way MLR 5 day | 26.2 | HPAEC none | 11.3 |
| Two Way MLR 7 day | 13.3 | HPAEC TNF alpha + IL-1 beta | 11.7 |
| PBMC rest | 14.5 | Lung fibroblast none | 18.9 |
| PBMC PWM | 83.5 | Lung fibroblast TNF alpha + IL-1 beta | 22.8 |
| PBMC PHA-L | 31.9 | Lung fibroblast IL-4 | 25.9 |
| Ramos (B cell) none | 11.4 | Lung fibroblast IL-9 | 13.4 |
| Ramos (B cell) ionomycin | 34.4 | Lung fibroblast IL-13 | 18.9 |
| B lymphocytes PWM | 60.3 | Lung fibroblast IFN gamma | 46.0 |
| B lymphocytes CD40L and IL-4 | 16.6 | Dermal fibroblast CCD1070 rest | 47.0 |
| EOL-1 dbcAMP | 34.2 | Dermal fibroblast CCD1070 TNF alpha | 83.5 |
| EOL-1 dbcAMP PMA/ionomycin | 100.0 | Dermal fibroblast CCD1070 IL-1 beta | 23.7 |
| Dendritic cells none | 13.7 | Dermal fibroblast IFN gamma | 18.3 |
| Dendritic cells LPS | 16.5 | Dermal fibroblast IL-4 | 25.2 |
| Dendritic cells anti-CD40 | 6.3 | IBD Colitis 2 | 2.3 |
| Monocytes rest | 23.5 | IBD Crohn's | 4.3 |
| Monocytes LPS | 84.1 | Colon | 24.5 |
| Macrophages rest | 23.3 | Lung | 23.7 |
| Macrophages LPS | 31.4 | Thymus | 39.0 |
| HUVEC none | 15.0 | Kidney | 44.4 |
| HUVEC starved | 30.6 | | |

CNS_neurodegeneration_v1.0 Summary: Ag2304 Expression of the NOV3 gene in this panel is ubiquitous. While this gene does not show differential expression between Alzheimer's discased brains and control brains, this panel confirms the expression of this gene in the brains of an independent group of patients. See Panel 1.3d for utility of this gene in the central nervous system.

Panel 1.3D Summary: Ag2304 The NOV3 gene, a homolog of the *Drosophila* pecanex gene, is widely expressed across the samples in this panel, with highest expression in the hippocampus (CT=28.6). In addition, this gene is expressed at moderate to high levels in all CNS regions examined. Expression of this gene in both the mother and developing embryo is critical for normal CNS development. Furthermore, expression of this protein appears to be involved in stem cell fate determination, where removal of this protein increases neural precursor cells. Therefore, downregulation of this gene could be used in neural stem cell research and therapy to control the fate of stem cells and increasing the resulting numbers of post-mitotic neurons.

The NOV3 gene is modestly expressed in a wide variety of metabolic tissues including adipose, adrenal, pancreas, thyroid, pituitary, heart, adult and fetal skeletal muscle, and adult and fetal liver. This widespread expression in tissues with metabolic function suggests that the NOV3 gene product may be important for the pathogenesis, diagnosis, and/or treatment of metabolic disease in any or all of these tissues, including obesity and diabetes.

References:
1. LaBonne S G, Furst A. Differentiation in vitro of neural precursor cells from normal and Pecanex mutant *Drosophila* embryos. J Neurogenet 1989 May 5(2):99–104

Early gastrula embryos, lacking both maternally and zygotically expressed activity of the neurogenic pecanex locus, are shown to contain a greater than wild-type number of stably determined neural precursor cells which can differentiate into neurons in culture.

2. LaBonne S G, Sunitha I, Mahowald A P. Molecular genetics of pecanex, a maternal-effect neurogenic locus of *Drosophila melanogaster* that potentially encodes a large transmembrane protein. Dev Biol 1989 November;136(1):1–16

In the absence of maternal expression of the pecanex gene, the embryo develops severe hyperneuralization similar to that characteristic of Notch mutant embryos. We have extended a previous molecular analysis of the chromosomal interval that encompasses pecanex by using additional deficiencies to localize the locus on the molecular map. RNA blot analysis shows that the locus encodes a rare 9-kb transcript as well as minor transcripts of 3.7 and 2.3 kb. The temporal expression of these transcripts is appropriate for a neurogenic locus. Phenocopies of the mutant phenotype have been produced following microinjection of antisense RNA corresponding to a portion of the pecanex transcripts. Conceptual translation of a partial coding sequence compiled from cDNA and genomic clones indicates that the pecanex locus potentially encodes a large, membrane-spanning protein.

Panel 2D Summary: Ag2304 The expression of this gene appears to be highest in a sample derived from normal lung tissue. Thus, the expression of this gene could be used to distinguish normal lung tissue from other tissues in the panel. Of note is the difference in expression between samples derived from ovarian cancer and normal adjacent tissue. This difference in levels of expression is also notable in samples derived from gastric cancer when compared to their normal counterparts. Thus, the expression of this gene could be used to distinguish ovarian or gastric cancer form their normal adjacent tissues. Moreover, therapeutic modulation of this gene, through the use of small molecule drugs, antibodies or protein therapeutics might be of use in the treatment of ovarian or gastric cancer.

Panel 4D Summary: Ag 2304 This NOV3 transcript is detected ubiquitously throughout this panel, with highest expression of this transcript in activated eosinophils (CT=28.1). This indicates an up-regulation of this transcript in these cells upon activation. Eosinophils contribute to the pathology of several atopic diseases such as asthma, atopic dermatitis, and rhinitis. Therefore, modulation of the activity or activation of the protein encoded by the NOV3 gene may be beneficial for the treatment of those diseases. The NOV3 gene is also highly expressed in effector T cells, activated monocytes and dermal fibroblasts upon treatment with TNF-a and IL-1b. Modulation of the expression of this transcript, which encodes for a Pecanex like molecule, could be beneficial in the treatment of inflammatory diseases associated with T cell activation as well as eosinophil activation including atopic diseases and autoimmune diseases such as rheumatoid arthritis, inflammatory bowel disease and skin inflammation.

NOV4

Expression of gene NOV4 was assessed using the primer-probe set Ag2428, described in Table 36. Results of the RTQ-PCR runs are shown in Tables 37, 38, 39 and 40.

TABLE 36

Probe Name Ag2428

| Primers | Sequences | Length | Start Position | SEQ ID NO: |
|---|---|---|---|---|
| Forward | 5'-gagccagggctgctgtata-3' | 19 | 1419 | 154 |
| Probe | TET-5'-cctctcaggaacatgctaccaaaatt-3'-TAMRA | 26 | 1439 | 155 |
| Reverse | 5'-tagattgagggcagcagtca-3' | 20 | 1476 | 156 |

TABLE 37

CNS_neurodegeneration_v1.0

| Tissue Name | Rel. Exp. (%) Ag2428, Run 206271177 | Tissue Name | Rel. Exp. (%) Ag2428, Run 206271177 |
|---|---|---|---|
| AD 1 Hippo | 7.9 | Control (Path) 3 Temporal Ctx | 3.5 |
| AD 2 Hippo | 22.2 | Control (Path) 4 Temporal Ctx | 40.3 |
| AD 3 Hippo | 12.8 | AD 1 Occipital Ctx | 18.3 |
| AD 4 Hippo | 5.1 | AD 2 Occipital Ctx (Missing) | 0.0 |
| AD 5 Hippo | 100.0 | AD 3 Occipital Ctx | 7.0 |
| AD 6 Hippo | 32.5 | AD 4 Occipital Ctx | 20.3 |
| Control 2 Hippo | 10.9 | AD 5 Occipital Ctx | 25.0 |
| Control 4 Hippo | 17.0 | AD 5 Occipital Ctx | 16.5 |
| Control (Path) 3 Hippo | 6.7 | Control 1 Occipital Ctx | 6.0 |
| AD 1 Temporal Ctx | 16.6 | Control 2 Occipital Ctx | 21.0 |

TABLE 37-continued

CNS_neurodegeneration_v1.0

| Tissue Name | Rel. Exp. (%) Ag2428, Run 206271177 | Tissue Name | Rel. Exp. (%) Ag2428, Run 206271177 |
|---|---|---|---|
| AD 2 Temporal Ctx | 23.2 | Control 3 Occipital Ctx | 23.2 |
| AD 3 Temporal Ctx | 9.4 | Control 4 Occipital Ctx | 6.0 |
| AD 4 Temporal Ctx | 25.9 | Control (Path) 1 Occipital Ctx | 50.3 |
| AD 5 Inf Temporal Ctx | 40.1 | Control (Path) 2 Occipital Ctx | 13.2 |
| AD 5 Sup Temporal Ctx | 33.7 | Control (Path) 3 Occipital Ctx | 1.1 |
| AD 6 Inf Temporal Ctx | 35.6 | Control (Path) 4 Occipital Ctx | 30.4 |
| AD 6 Sup Temporal Ctx | 48.3 | Control 1 Parietal Ctx | 12.4 |
| Control 1 Temporal Ctx | 8.0 | Control 2 Parietal Ctx | 46.0 |
| Control 2 Temporal Ctx | 8.5 | Control 3 Parietal Ctx | 23.7 |
| Control 3 Temporal Ctx | 14.7 | Control (Path) 1 Parietal Ctx | 38.7 |
| Control 3 Temporal Ctx | 11.3 | Control (Path) 2 Parietal Ctx | 20.4 |
| Control (Path) 1 Temporal Ctx | 37.6 | Control (Path) 3 Parietal Ctx | 5.4 |
| Control (Path) 2 Temporal Ctx | 34.9 | Control (Path) 4 Parietal Ctx | 43.2 |

TABLE 38

Panel 1.3D

| Tissue Name | Rel. Exp. (%) Ag2428, Run 159361380 | Tissue Name | Rel. Exp. (%) Ag2428, Run 159361380 |
|---|---|---|---|
| Liver adenocarcinoma | 10.7 | Kidney (fetal) | 7.1 |
| Pancreas | 2.4 | Renal ca. 786-0 | 6.6 |
| Pancreatic ca. CAPAN 2 | 6.0 | Renal ca. A498 | 18.8 |
| Adrenal gland | 5.3 | Renal ca. RXF 393 | 3.8 |
| Thyroid | 2.5 | Renal ca. ACHN | 1.1 |
| Salivary gland | 3.7 | Renal ca. UO-31 | 4.5 |
| Pituitary gland | 7.2 | Renal ca. TK-10 | 5.1 |
| Brain (fetal) | 5.2 | Liver | 1.9 |
| Brain (whole) | 5.1 | Liver (fetal) | 11.4 |
| Brain (amygdala) | 5.1 | Liver ca. (hepatoblast) HepG2 | 8.0 |
| Brain (cerebellum) | 2.7 | Lung | 8.5 |
| Brain (hippocampus) | 17.6 | Lung (fetal) | 4.7 |
| Brain (*substantia nigra*) | 1.8 | Lung ca. (small cell) LX-1 | 7.5 |
| Brain (thalamus) | 4.9 | Lung ca. (small cell) NCI-H69 | 11.9 |
| Cerebral Cortex | 2.8 | Lung ca. (s.cell var.) SHP-77 | 25.2 |
| Spinal cord | 3.8 | Lung ca. (large cell)NCI-H460 | 8.8 |
| glio/astro U87-MG | 12.9 | Lung ca. (non-sm. cell) A549 | 8.3 |
| glio/astro U-118-MG | 39.5 | Lung ca. (non-s.cell) NCI-H23 | 18.3 |
| astrocytoma SW1783 | 5.4 | Lung ca. (non-s.cell) HOP-62 | 6.6 |
| neuro*; met SK-N-AS | 100.0 | Lung ca. (non-s.cl) NCI-H522 | 8.4 |
| astrocytoma SF-539 | 7.6 | Lung ca. (squam.) SW 900 | 9.7 |
| astrocytoma SNB-75 | 19.8 | Lung ca. (squam.) NCI-H596 | 5.4 |
| glioma SNB-19 | 12.0 | Mammary gland | 5.9 |
| glioma U251 | 11.3 | Breast ca.* (pl.ef) MCF-7 | 10.9 |

TABLE 38-continued

Panel 1.3D

| Tissue Name | Rel. Exp. (%) Ag2428, Run 159361380 | Tissue Name | Rel. Exp. (%) Ag2428, Run 159361380 |
|---|---|---|---|
| glioma SF-295 | 7.4 | Breast ca.* (pl.ef) MDA-MB-231 | 66.0 |
| Heart (Fetal) | 2.0 | Breast ca.* (pl. ef) T47D | 9.6 |
| Heart | 5.1 | Breast ca. BT-549 | 34.4 |
| Skeletal muscle (Fetal) | 8.5 | Breast ca. MDA-N | 17.7 |
| Skeletal muscle | 1.2 | Ovary | 2.1 |
| Bone marrow | 17.8 | Ovarian ca. OVCAR-3 | 10.8 |
| Thymus | 5.6 | Ovarian ca. OVCAR-4 | 0.6 |
| Spleen | 10.1 | Ovarian ca. OVCAR-5 | 5.6 |
| Lymph node | 9.2 | Ovarian ca. OVCAR-8 | 10.0 |
| Colorectal | 6.9 | Ovarian ca. IGROV-1 | 2.1 |
| Stomach | 7.3 | Ovarian ca. (ascites) SK-OV-3 | 15.1 |
| Small intestine | 8.1 | Uterus | 3.7 |
| Colon ca. SW480 | 8.5 | Placenta | 3.8 |
| Colon ca.* SW620 (SW480 met) | 13.6 | Prostate | 6.0 |
| Colon ca. HT29 | 11.0 | Prostate ca.* (bone met) PC-3 | 5.8 |
| Colon ca. HCT-116 | 12.9 | Testis | 9.3 |
| Colon ca. CaCo-2 | 12.3 | Melanoma Hs688(A).T | 2.6 |
| CC Well to Mod Diff (ODO3866) | 7.6 | Melanoma* (met) Hs688(B).T | 1.9 |
| Colon ca. HCC-2998 | 33.0 | Melanoma UACC-62 | 3.8 |
| Gastric ca. (liver met) NCI-N87 | 25.9 | Melanoma M14 | 5.8 |
| Bladder | 10.2 | Melanoma LOX IMVI | 5.2 |
| Trachea | 9.0 | Melanoma* (met) SK-MEL-5 | 10.3 |
| Kidney | 2.5 | Adipose | 6.3 |

TABLE 39

Panel 2D

| Tissue Name | Rel. Exp. (%) Ag2428, Run 159361727 | Tissue Name | Rel. Exp. (%) Ag2428, Run 159361727 |
|---|---|---|---|
| Normal Colon | 80.1 | Kidney Margin 8120608 | 2.1 |
| CC Well to Mod Diff (ODO3866) | 13.7 | Kidney Cancer 8120613 | 15.3 |
| CC Margin (ODO3866) | 7.7 | Kidney Margin 8120614 | 6.8 |
| CC Gr.2 rectosigmoid (ODO3868) | 25.5 | Kidney Cancer 9010320 | 21.3 |
| CC Margin (ODO3868) | 6.6 | Kidney Margin 9010321 | 17.4 |
| CC Mod Diff (ODO3920) | 70.2 | Normal Uterus | 3.2 |
| CC Margin (ODO3920) | 30.4 | Uterine Cancer 064011 | 21.3 |
| CC Gr.2 ascend colon (ODO3921) | 52.1 | Normal Thyroid | 9.9 |
| CC Margin (ODO3921) | 11.1 | Thyroid Cancer | 5.8 |
| CC from Partial Hepatectomy (ODO4309) Mets | 50.7 | Thyroid Cancer A302152 | 27.7 |
| Liver Margin (ODO4309) | 22.7 | Thyroid Margin A302153 | 37.6 |
| Colon mets to lung (OD04451-01) | 29.1 | Normal Breast | 18.7 |
| Lung Margin (OD04451-02) | 7.0 | Breast Cancer | 26.4 |
| Normal Prostate 6546-1 | 8.8 | Breast Cancer (OD04590-01) | 75.3 |
| Prostate Cancer (OD04410) | 49.3 | Breast Cancer Mets (OD04590-03) | 87.1 |
| Prostate Margin (OD04410) | 41.2 | Breast Cancer Metastasis | 48.0 |

TABLE 39-continued

Panel 2D

| Tissue Name | Rel. Exp. (%) Ag2428, Run 159361727 | Tissue Name | Rel. Exp. (%) Ag2428, Run 159361727 |
| --- | --- | --- | --- |
| Prostate Cancer (OD04720-01) | 52.9 | Breast Cancer | 49.7 |
| Prostate Margin (OD04720-02) | 59.5 | Breast Cancer | 36.3 |
| Normal Lung | 81.8 | Breast Cancer 9100266 | 18.4 |
| Lung Met to Muscle (ODO4286) | 30.1 | Breast Margin 9100265 | 14.9 |
| Muscle Margin (ODO4286) | 13.9 | Breast Cancer A209073 | 55.5 |
| Lung Malignant Cancer (OD03126) | 47.3 | Breast Margin A2090734 | 45.1 |
| Lung Margin (OD03126) | 41.8 | Normal Liver | 15.8 |
| Lung Cancer (OD04404) | 28.5 | Liver Cancer | 14.4 |
| Lung Margin (OD04404) | 16.7 | Liver Cancer 1025 | 5.7 |
| Lung Cancer (OD04565) | 28.3 | Liver Cancer 1026 | 5.7 |
| Lung Margin (OD04565) | 14.0 | Liver Cancer 6004-T | 7.9 |
| Lung Cancer (OD04237-01) | 62.4 | Liver Tissue 6004-N | 8.1 |
| Lung Margin (OD04237-02) | 28.3 | Liver Cancer 6005-T | 5.2 |
| Ocular Mel Met to Liver (ODO4310) | 23.5 | Liver Tissue 6005-N | 0.8 |
| Liver Margin (ODO4310) | 11.3 | Normal Bladder | 81.8 |
| Melanoma Metastasis | 40.9 | Bladder Cancer | 9.2 |
| Lung Margin (OD04321) | 26.2 | Bladder Cancer | 62.0 |
| Normal Kidney | 54.3 | Bladder Cancer (OD04718-01) | 32.8 |
| Kidney Ca, Nuclear grade 2 (OD04338) | 40.1 | Bladder Normal Adjacent (OD04718-03) | 24.8 |
| Kidney Margin (OD04338) | 45.7 | Normal Ovary | 0.8 |
| Kidney Ca Nuclear grade 1/2 (OD04339) | 82.9 | Ovarian Cancer | 51.8 |
| Kidney Margin (OD04339) | 45.4 | Ovarian Cancer (OD04768-07) | 86.5 |
| Kidney Ca, Clear cell type (OD04340) | 49.3 | Ovary Margin (OD04768-08) | 8.5 |
| Kidney Margin (OD04340) | 48.0 | Normal Stomach | 20.7 |
| Kidney Ca, Nuclear grade 3 (OD04348) | 24.3 | Gastric Cancer 9060358 | 6.9 |
| Kidney Margin (OD04348) | 40.3 | Stomach Margin 9060359 | 13.1 |
| Kidney Cancer (OD04622-01) | 10.7 | Gastric Cancer 9060395 | 23.5 |
| Kidney Margin (OD04622-03) | 3.1 | Stomach Margin 9060394 | 18.9 |
| Kidney Cancer (OD04450-01) | 24.8 | Gastric Cancer 9060397 | 39.8 |
| Kidney Margin (OD04450-03) | 25.5 | Stomach Margin 9060396 | 7.1 |
| Kidney Cancer 8120607 | 2.7 | Gastric Cancer 064005 | 100.0 |

TABLE 40

Panel 4D

| Tissue Name | Rel. Exp. (%) Ag2428, Run 159362614 | Tissue Name | Rel. Exp. (%) Ag2428, Run 159362614 |
| --- | --- | --- | --- |
| Secondary Th1 act | 26.8 | HUVEC IL-1beta | 9.2 |
| Secondary Th2 act | 34.6 | HUVEC IFN gamma | 14.1 |
| Secondary Tr1 act | 37.6 | HUVEC TNF alpha + IFN gamma | 8.4 |
| Secondary Th1 rest | 10.7 | HUVEC TNF alpha + IL4 | 12.0 |
| Secondary Th2 rest | 13.6 | HUVEC IL-11 | 7.9 |
| Secondary Tr1 rest | 16.7 | Lung Microvascular EC none | 10.9 |
| Primary Th1 act | 36.9 | Lung Microvascular EC TNFalpha + IL-1beta | 9.9 |
| Primary Th2 act | 48.3 | Microvascular Dermal EC none | 17.0 |
| Primary Tr1 act | 50.7 | Microvasular Dermal EC TNFalpha + IL-1beta | 10.6 |

TABLE 40-continued

Panel 4D

| Tissue Name | Rel. Exp. (%) Ag2428, Run 159362614 | Tissue Name | Rel. Exp. (%) Ag2428, Run 159362614 |
|---|---|---|---|
| Primary Th1 rest | 74.2 | Bronchial epithelium TNFalpha + IL1beta | 9.8 |
| Primary Th2 rest | 41.5 | Small airway epithelium none | 3.6 |
| Primary Tr1 rest | 28.9 | Small airway epithelium TNFalpha + IL-1beta | 38.7 |
| CD45RA CD4 lymphocyte act | 22.7 | Coronery artery SMC rest | 9.9 |
| CD45RO CD4 lymphocyte act | 31.0 | Coronery artery SMC TNFalpha + IL-1beta | 4.2 |
| CD8 lymphocyte act | 15.9 | Astrocytes rest | 5.9 |
| Secondary CD8 lymphocyte rest | 19.6 | Astrocytes TNFalpha + IL-1beta | 5.8 |
| Secondary CD8 lymphocyte act | 17.9 | KU-812 (Basophil) rest | 8.7 |
| CD4 lymphocyte none | 11.6 | KU-812 (Basophil) PMA/ionomycin | 31.6 |
| 2ry Th1/Th2/Tr1_anti-CD95 CH11 | 18.8 | CCD1106 (Keratinocytes) none | 12.3 |
| LAK cells rest | 20.4 | CCD1106 (Keratinocytes) TNFalpha + IL-1beta | 8.4 |
| LAK cells IL-2 | 27.7 | Liver cirrhosis | 4.7 |
| LAK cells IL-2 + IL-12 | 20.0 | Lupus kidney | 2.1 |
| LAK cells IL-2 + IFN gamma | 38.4 | NCI-H292 none | 25.5 |
| LAK cells IL-2 + IL-18 | 43.5 | NCI-H292 IL-4 | 37.1 |
| LAK cells PMA/ionomycin | 13.6 | NCI-H292 IL-9 | 36.9 |
| NK Cells IL-2 rest | 21.2 | NCI-H292 IL-13 | 15.6 |
| Two Way MLR 3 day | 23.8 | NCI-H292 IFN gamma | 14.1 |
| Two Way MLR 5 day | 11.3 | HPAEC none | 11.1 |
| Two Way MLR 7 day | 11.3 | HPAEC TNF alpha + IL-1 beta | 13.5 |
| PBMC rest | 7.9 | Lung fibroblast none | 10.7 |
| PBMC PWM | 60.3 | Lung fibroblast TNF alpha + IL-1 beta | 5.0 |
| PBMC PHA-L | 23.5 | Lung fibroblast IL-4 | 18.6 |
| Ramos (B cell) none | 23.5 | Lung fibroblast IL-9 | 13.0 |
| Ramos (B cell) ionomycin | 80.7 | Lung fibroblast IL-13 | 11.0 |
| B lymphocytes PWM | 100.0 | Lung fibroblast IFN gamma | 13.6 |
| B lymphocytes CD40L and IL-4 | 44.8 | Dermal fibroblast CCD1070 rest | 27.9 |
| EOL-1 dbcAMP | 11.0 | Dermal fibroblast CCD1070 TNF alpha | 82.9 |
| EOL-1 dbcAMP PMA/ionomycin | 19.6 | Dermal fibroblast CCD1070 IL-1 beta | 15.0 |
| Dendritic cells none | 9.5 | Dermal fibroblast IFN gamma | 10.1 |
| Dendritic cells LPS | 7.6 | Dermal fibroblast IL-4 | 11.9 |
| Dendritic cells anti-CD40 | 5.5 | IBD Colitis 2 | 2.8 |
| Monocytes rest | 15.8 | IBD Crohn's | 2.2 |
| Monocytes LPS | 11.0 | Colon | 11.0 |
| Macrophages rest | 9.3 | Lung | 5.3 |
| Macrophages LPS | 5.2 | Thymus | 18.6 |
| HUVEC none | 12.2 | Kidney | 41.8 |
| HUVEC starved | 33.0 | | |

CNS_neurodegeneration_v1.0 Summary: Ag2428 While results from this experiment show that this gene is not differentially expressed in the Alzheimer's diseased brain, this panel confirms the expression of this gene at moderate levels in the CNS in an independent group of patients. Please see Panel 1.3D for a discussion of utility of this gene in the central nervous system.

Panel 1.3D Summary: Ag2428 The NOV4 gene is expressed widely across many samples in this panel, with highest expression in a sample derived from a neuroblastoma cell line(CT=29.8). Moreover, there appears to be a cluster of expression associated with breast cancer cell lines. Thus, the expression of this gene could be used to distinguish these samples from others in the panel.

In addition, the NOV4 gene is moderately expressed in a number of metabolic tissues including adipose, adrenal, pituitary, heart, fetal skeletal muscle and fetal liver. Thus, this gene product may be an important small molecule target for the treatment of metabolic disease, including obesity and Type 2 diabetes.

This gene is expressed at low levels in the CNS, and is an an aurora-related kinase. The aurora-related kinases are involed in the control of the cell-cycle, and may be useful in the control of cell fate in neural stem cells. This protein may therefore be of usc in stem cell research or therapy.

References:

Severson A F, Hamill D R, Carter J C, Schumacher J, Bowerman B. The aurora-related kinase AIR-2 recruits ZEN-4/CeMKLP1 to the mitotic spindle at metaphase and is required for cytokinesis. Curr Biol 2000 Oct. 5;10(19):1162–71

BACKGROUND: The Aurora/Ip11p-related kinase AIR-2 is required for mitotic chromosome segregation and cytokinesis in early *Caenorhabditis elegans* embryos. Previous studies have relied on non-conditional mutations or RNA-mediated interference (RNAi) to inactivate AIR-2. It has therefore not been possible to determine whether AIR-2 functions directly in cytokinesis or if the cleavage defect results indirectly from the failure to segregate DNA. One intriguing hypothesis is that AIR-2 acts to localize the mitotic kinesin-like protein ZEN-4 (also known as CeMKLP1), which later functions in cytokinesis. RESULTS: Using conditional alleles, we established that AIR-2 is required at metaphase or early anaphase for normal segregation of chromosomes, localization of ZEN-4, and cytokinesis. ZEN-4 is first required late in cytokinesis, and also functions to maintain cell separation through much of the subsequent interphase. DNA segregation defects alone were not sufficient to disrupt cytokinesis in other mutants, suggesting that AIR-2 acts specifically during cytokinesis through ZEN-4. AIR-2 and ZEN-4 shared similar genetic interactions with the formin homology (FH) protein CYK-1, suggesting that AIR-2 and ZEN-4 function in a single pathway, in parallel to a contractile ring pathway that includes CYK-1. Using in vitro co-immunoprecipitation experiments, we found that AIR-2 and ZEN-4 interact directly.
CONCLUSIONS: AIR-2 has two functions during mitosis: one in chromosome segregation, and a second, independent function in cytokinesis through ZEN-4. AIR-2 and ZEN-4 may act in parallel to a second pathway that includes CYK-1.

Panel 2D Summary: Ag2428 The expression of this gene is found widely across a number of samples in this panel. It is found to be highest in a sample derived from a gastric cancer. Of note is the association observed between gastric cancer samples, when compared to their normal adjacent samples. This association is also notable in ovarian cancer Panel 4D Summary: Ag 2428 This transcript is ubiquitously expressed in all cells throughout the panel. However, the highest expression of this transcript is found in B cells upon activation with the B cell mitogen, PWM. Significant expression of this transcript in the activated Ramos B cell line is consistent with this finding. This transcript encodes an aurora-related kinase 1 which belongs to a family of oncogenic mitogenic serine threonine kinases (see reference below). Therefore, modulation of the expression of this transcript by small molecules, may be beneficial for the treatment of diaseases associated with hyperproliferation of B cells including B cell lymphomas, hyperglobulinemia and autoimmune disease such as lupus and rheumatoid arthritis. This transcript is also expressed in dermal fibroblasts upon treatment with TNF-a and Il-I and in primary Th1 cells suggesting that modulation of this transcript may be important in the treatment of T cell mediated diseases and inflammatory skin diseases.

References:

1. J Cell Sci 1999 November;112 (Pt 21):3591–601. Aurora/Ip111p-related kinases, a new oncogenic family of mitotic serine-threonine kinases. Giet R, Prigent C.

CNRS UPR41| Universite de Rennes 1, Groupe Cycle Cellulaire, Faculte de Medecine, CS 34317, France.

During the past five years, a growing number of serine-threonine kinases highly homologous to the *Saccharomyces cerevisiae* IpI11p kinase have been isolated in various organisms. A *Drosophila melanogaster* homologue, aurora, was the first to be isolated from a multicellular organism. Since then, several related kinases have been found in mammalian cells. They localise to the mitotic apparatus: in the centrosome, at the poles of the bipolar spindle or in the midbody. The kinases are necessary for completion of mitotic events such as centrosome separation, bipolar spindle assembly and chromosome segregation. Extensive research is now focusing on these proteins because the three human homologues are overexpressed in various primary cancers. Furthermore, overexpression of one of these kinases transforms cells. Because of the myriad of kinases identified, we suggest a generic name: Aurora/IpI11p-related kinase (AIRK). We denote AIRKs with a species prefix and a number, e.g. HsAIRK1.

NOV5

Expression of gene NOV5 was assessed using the primer-probe set Ag2423, described in Table 41. Results of the RTQ-PCR runs are shown in Tables 42, 43 and 44.

TABLE 41

Probe Name Ag2423

| Primers | Sequences | Length | Start Position | SEQ ID NO: |
|---|---|---|---|---|
| Forward | 5'-aactgccactggtgacactt-3' | 20 | 243 | 157 |
| Probe | TET-5'-cacactcagtgtcggttaaaattactga-3'-TAMRA | 28 | 263 | 158 |
| Reverse | 5'-tgaattcttccaccatgagaa-3' | 21 | 315 | 159 | and breast cancer. Thus, the expression of this gene could be used to distinguish gastric cancer, breast cancer and ovarian cancer from their normal adjacent tissues. Morover, therapeutic modulation of this gene, through the use of small molecule drugs, antibodies or protein therapeutics might be of benefit in the treatment of gastric, breast or ovarian cancer.

TABLE 42

Panel 1.3D

| Tissue Name | Rel. Exp. (%) Ag2423, Run 159337657 | Tissue Name | Rel. Exp. (%) Ag2423, Run 159337657 |
|---|---|---|---|
| Liver adenocarcinoma | 25.9 | Kidney (fetal) | 0.0 |
| Pancreas | 8.4 | Renal ca. 786-0 | 11.7 |
| Pancreatic ca. CAPAN 2 | 7.1 | Renal ca. A498 | 7.2 |
| Adrenal gland | 65.1 | Renal ca. RXF 393 | 9.6 |
| Thyroid | 4.0 | Renal ca. ACHN | 8.5 |
| Salivary gland | 41.8 | Renal ca.UO-31 | 8.4 |
| Pituitary gland | 9.9 | Renal ca. TK-10 | 4.5 |
| Brain (fetal) | 75.8 | Liver | 13.6 |
| Brain (whole) | 5.1 | Liver (fetal) | 28.1 |
| Brain (amygdala) | 5.8 | Liver ca. (hepatoblast) HepG2 | 12.9 |
| Brain (cerebellum) | 3.8 | Lung | 21.0 |
| Brain (hippocampus) | 66.4 | Lung (fetal) | 15.4 |
| Brain (*substantia nigra*) | 20.4 | Lung ca. (small cell) LX-1 | 4.9 |
| Brain (thalamus) | 7.4 | Lung ca. (small cell) NCI-H69 | 4.6 |
| Cerebral Cortex | 52.9 | Lung ca. (s.cell var.) SHP-77 | 14.7 |
| Spinal cord | 22.5 | Lung ca. (large cell)NCI-H460 | 15.7 |
| glio/astro U87-MG | 11.5 | Lung ca. (non-sm. cell) A549 | 9.8 |
| glio/astro U-118-MG | 11.1 | Lung ca. (non-s.cell) NCI-H23 | 12.2 |
| astrocytoma SW1783 | 15.8 | Lung ca. (non-s.cell) HOP-62 | 18.2 |
| neuro*; met SK-N-AS | 10.2 | Lung ca. (non-s.cl) NCI-H522 | 10.7 |
| astrocytoma SF-539 | 9.5 | Lung ca. (squam.) SW 900 | 8.0 |
| astrocytoma SNB-75 | 0.0 | Lung ca. (squam.) NCI-H596 | 9.3 |
| glioma SNB-19 | 16.6 | Mammary gland | 13.0 |
| glioma U251 | 5.2 | Breast ca.* (pl.ef) MCF-7 | 3.1 |
| glioma SF-295 | 0.0 | Breast ca.* (pl.ef) MDA-MB-231 | 8.3 |
| Heart (Fetal) | 24.1 | Breast ca.* (pl. ef) T47D | 4.0 |
| Heart | 33.0 | Breast ca. BT-549 | 6.1 |
| Skeletal muscle (Fetal) | 6.5 | Breast ca. MDA-N | 0.0 |
| Skeletal muscle | 10.8 | Ovary | 7.2 |
| Bone marrow | 5.7 | Ovarian ca. OVCAR-3 | 16.7 |
| Thymus | 0.0 | Ovarian ca. OVCAR-4 | 13.2 |
| Spleen | 33.0 | Ovarian ca. OVCAR-5 | 10.6 |
| Lymph node | 13.7 | Ovarian ca. OVCAR-8 | 0.0 |
| Colorectal | 28.5 | Ovarian ca. IGROV-1 | 9.3 |
| Stomach | 4.8 | Ovarian ca. (ascites) SK-OV-3 | 0.0 |
| Small intestine | 8.6 | Uterus | 0.0 |
| Colon ca. SW480 | 0.0 | Placenta | 8.0 |
| Colon ca.* SW620 (SW480 met) | 4.4 | Prostate | 0.0 |
| Colon ca. HT29 | 5.3 | Prostate ca.* (bone met) PC-3 | 0.0 |
| Colon ca. HCT-116 | 19.9 | Testis | 0.0 |
| Colon ca. CaCo-2 | 9.7 | Melanoma Hs688(A).T | 0.0 |
| CC Well to Mod Diff (ODO3866) | 0.0 | Melanoma* (met) Hs688(B).T | 0.0 |
| Colon ca. HCC-2998 | 0.0 | Melanoma UACC-62 | 6.6 |
| Gastric ca. (liver met) NCI-N87 | 0.0 | Melanoma M14 | 5.1 |
| Bladder | 100.0 | Melanoma LOX IMVI | 8.2 |
| Trachea | 4.4 | Melanoma* (met) SK-MEL-5 | 8.7 |
| Kidney | 25.7 | Adipose | 79.6 |

TABLE 43

Panel 2D

| Tissue Name | Rel. Exp. (%) Ag2423, Run 159338041 | Tissue Name | Rel. Exp. (%) Ag2423, Run 159338041 |
|---|---|---|---|
| Normal Colon | 34.6 | Kidney Margin 8120608 | 0.0 |
| CC Well to Mod Diff (ODO3866) | 34.2 | Kidney Cancer 8120613 | 0.0 |
| CC Margin (ODO3866) | 38.7 | Kidney Margin 8120614 | 0.0 |
| CC Gr.2 rectosigmoid (ODO3868) | 9.1 | Kidney Cancer 9010320 | 0.0 |
| CC Margin (ODO3868) | 11.0 | Kidney Margin 9010321 | 0.0 |
| CC Mod Diff(ODO3920) | 12.9 | Normal Uterus | 8.9 |
| CC Margin (ODO3920) | 17.7 | Uterine Cancer 064011 | 12.2 |
| CC Gr.2 ascend colon (ODO3921) | 79.0 | Normal Thyroid | 2.6 |
| CC Margin (ODO3921) | 17.1 | Thyroid Cancer | 5.6 |
| CC from Partial Hepatectomy (ODO4309) Mets | 24.1 | Thyroid Cancer A302152 | 7.7 |
| Liver Margin (ODO4309) | 17.8 | Thyroid Margin A302153 | 10.9 |
| Colon mets to lung (OD04451-01) | 2.0 | Normal Breast | 7.2 |
| Lung Margin (OD04451-02) | 8.0 | Breast Cancer | 2.4 |
| Normal Prostate 6546-1 | 2.8 | Breast Cancer (OD04590-01) | 16.0 |
| Prostate Cancer (OD04410) | 45.4 | Breast Cancer Mets (OD04590-03) | 19.5 |
| Prostate Margin (OD04410) | 27.4 | Breast Cancer Metastasis | 11.2 |
| Prostate Cancer (OD04720-01) | 9.8 | Breast Cancer | 10.9 |
| Prostate Margin (OD04720-02) | 29.3 | Breast Cancer | 3.6 |
| Normal Lung | 38.2 | Breast Cancer 9100266 | 12.9 |
| Lung Met to Muscle (ODO4286) | 36.3 | Breast Margin 9100265 | 4.6 |
| Muscle Margin (ODO4286) | 9.9 | Breast Cancer A209073 | 15.4 |
| Lung Malignant Cancer (OD03126) | 15.7 | Breast Margin A2090734 | 6.1 |
| Lung Margin (OD03126) | 12.0 | Normal Liver | 3.8 |
| Lung Cancer (OD04404) | 14.4 | Liver Cancer | 9.1 |
| Lung Margin (OD04404) | 10.1 | Liver Cancer 1025 | 3.8 |
| Lung Cancer (OD04565) | 7.4 | Liver Cancer 1026 | 2.7 |
| Lung Margin (OD04565) | 0.0 | Liver Cancer 6004-T | 3.2 |
| Lung Cancer (OD04237-01) | 43.8 | Liver Tissue 6004-N | 3.4 |
| Lung Margin (OD04237-02) | 12.9 | Liver Cancer 6005-T | 3.4 |
| Ocular Mel Met to Liver (ODO4310) | 3.0 | Liver Tissue 6005-N | 1.6 |
| Liver Margin (ODO4310) | 4.1 | Normal Bladder | 36.9 |
| Melanoma Metastasis | 33.2 | Bladder Cancer | 10.0 |
| Lung Margin (OD04321) | 23.7 | Bladder Cancer | 22.4 |
| Normal Kidney | 12.4 | Bladder Cancer (OD04718-01) | 100.0 |
| Kidney Ca, Nuclear grade 2 (OD04338) | 6.8 | Bladder Normal Adjacent (OD04718-03) | 13.1 |
| Kidney Margin (OD04338) | 6.2 | Normal Ovary | 3.0 |
| Kidney Ca Nuclear grade 1/2 (OD04339) | 20.7 | Ovarian Cancer | 18.2 |
| Kidney Margin (OD04339) | 11.8 | Ovarian Cancer (OD04768-07) | 47.6 |
| Kidney Ca, Clear cell type (OD04340) | 29.9 | Ovary Margin (OD04768-08) | 6.1 |
| Kidney Margin (OD04340) | 11.0 | Normal Stomach | 6.2 |
| Kidney Ca, Nuclear grade 3 (OD04348) | 5.8 | Gastric Cancer 9060358 | 0.0 |
| Kidney Margin (OD04348) | 9.8 | Stomach Margin 9060359 | 42.3 |
| Kidney Cancer (OD04622-01) | 0.0 | Gastric Cancer 9060395 | 37.4 |
| Kidney Margin (OD04622-03) | 0.0 | Stomach Margin 9060394 | 47.0 |
| Kidney Cancer (OD04450-01) | 7.5 | Gastric Cancer 9060397 | 76.3 |

TABLE 43-continued

Panel 2D

| Tissue Name | Rel. Exp. (%) Ag2423, Run 159338041 | Tissue Name | Rel. Exp. (%) Ag2423, Run 159338041 |
|---|---|---|---|
| Kidney Margin (OD04450-03) | 5.4 | Stomach Margin 9060396 | 3.1 |
| Kidney Cancer 8120607 | 0.0 | Gastric Cancer 064005 | 35.6 |

TABLE 44

Panel 4D

| Tissue Name | Rel. Exp. (%) Ag2423, Run 159338325 | Tissue Name | Rel. Exp. (%) Ag2423, Run 159338325 |
|---|---|---|---|
| Secondary Th1 act | 2.1 | HUVEC IL-1beta | 1.9 |
| Secondary Th2 act | 4.8 | HUVEC IFN gamma | 0.0 |
| Secondary Tr1 act | 1.4 | HUVEC TNF alpha + IFN gamma | 0.0 |
| Secondary Th1 rest | 7.5 | HUVEC TNF alpha + IL4 | 0.0 |
| Secondary Th2 rest | 10.2 | HUVEC IL-11 | 0.0 |
| Secondary Tr1 rest | 2.0 | Lung Microvascular EC none | 4.7 |
| Primary Th1 act | 2.3 | Lung Microvascular EC TNFalpha + IL-1beta | 3.5 |
| Primary Th2 act | 100.0 | Microvascular Dermal EC none | 8.0 |
| Primary Tr1 act | 3.4 | Microvasular Dermal EC TNFalpha + IL-1 beta | 15.3 |
| Primary Th1 rest | 0.9 | Bronchial epithelium TNFalpha + IL1beta | 1.3 |
| Primary Th2 rest | 3.8 | Small airway epithelium none | 3.6 |
| Primary Tr1 rest | 1.4 | Small airway epithelium TNFalpha + IL-1 beta | 0.0 |
| CD45RA CD4 lymphocyte act | 1.6 | Coronery artery SMC rest | 0.0 |
| CD45RO CD4 lymphocyte act | 0.0 | Coronery artery SMC TNFalpha + IL-1beta | 0.0 |
| CD8 lymphocyte act | 5.2 | Astrocytes rest | 5.1 |
| Secondary CD8 lymphocyte rest | 0.0 | Astrocytes TNFalpha + IL-1beta | 0.0 |
| Secondary CD8 lymphocyte act | 1.1 | KU-812 (Basophil) rest | 0.0 |
| CD4 lymphocyte none | 2.2 | KU-812 (Basophil) PMA/ionomycin | 2.1 |
| 2ry Th1/Th2/Tr1_anti-CD95 CH11 | 1.5 | CCD1106 (Keratinocytes) none | 1.5 |
| LAK cells rest | 7.6 | CCD1106 (Keratinocytes) TNFalpha + IL-1beta | 2.0 |
| LAK cells IL-2 | 5.8 | Liver cirrhosis | 2.1 |
| LAK cells IL-2 + IL-12 | 1.4 | Lupus kidney | 4.8 |
| LAK cells IL-2 + IFN gamma | 0.0 | NCI-H292 none | 1.6 |
| LAK cells IL-2 + IL-18 | 1.7 | NCI-H292 IL-4 | 6.6 |
| LAK cells PMA/ionomycin | 1.7 | NCI-H292 IL-9 | 0.0 |
| NK Cells IL-2 rest | 0.9 | NCI-H292 IL-13 | 0.0 |
| Two Way MLR 3 day | 0.0 | NCI-H292 IFN gamma | 1.3 |
| Two Way MLR 5 day | 1.8 | HPAEC none | 0.0 |
| Two Way MLR 7 day | 8.5 | HPAEC TNF alpha + IL-1 beta | 1.4 |
| PBMC rest | 1.8 | Lung fibroblast none | 0.9 |
| PBMC PWM | 1.8 | Lung fibroblast TNF alpha + IL-1 beta | 6.0 |
| PBMC PHA-L | 3.7 | Lung fibroblast IL-4 | 6.3 |
| Ramos (B cell) none | 2.0 | Lung fibroblast IL-9 | 1.0 |
| Ramos (B cell) ionomycin | 0.0 | Lung fibroblast IL-13 | 0.9 |
| B lymphocytes PWM | 0.0 | Lung fibroblast IFN gamma | 0.8 |
| B lymphocytes CD40L and IL-4 | 0.0 | Dermal fibroblast CCD1070 rest | 2.2 |
| EOL-1 dbcAMP | 4.2 | Dermal fibroblast CCD1070 TNF alpha | 2.0 |

TABLE 44-continued

Panel 4D

| Tissue Name | Rel. Exp. (%) Ag2423, Run 159338325 | Tissue Name | Rel. Exp. (%) Ag2423, Run 159338325 |
|---|---|---|---|
| EOL-1 dbcAMP PMA/ionomycin | 0.0 | Dermal fibroblast CCD1070 IL-1 beta | 0.0 |
| Dendritic cells none | 2.3 | Dermal fibroblast IFN gamma | 0.0 |
| Dendritic cells LPS | 4.3 | Dermal fibroblast IL-4 | 0.0 |
| Dendritic cells anti-CD40 | 0.0 | IBD Colitis 2 | 3.1 |
| Monocytes rest | 1.7 | IBD Crohn's | 1.8 |
| Monocytes LPS | 28.3 | Colon | 0.0 |
| Macrophages rest | 20.7 | Lung | 0.0 |
| Macrophages LPS | 1.1 | Thymus | 2.0 |
| HUVEC none | 2.0 | Kidney | 3.7 |
| HUVEC starved | 1.5 | | |

CNS_neurodegeneration_v1.0 Summary: Ag2423 Expression is low/undetected in all samples in this panel (CT>35). (Data not shown.)

Panel 1.3D Summary: Ag2423 This gene is expressed exclusively in a sample derived from bladder tissue. Thus, the expression of this gene could be used to distinguish bladder tissue from other tissues in the panel.

Panel 2D Summary: Ag2423 The expression of this gene is highest and almost exclusive to a sample derived from bladder cancer. This result is consistent with the expression detected in Panel 1.3D. Thus, the expression of this gene could be used to distinguish bladder cancer tissue from other tissues in the panel. Moreover, the therapeutic modulation of this gene, through the use of small molecule drugs, antibodies or protein therapeutics might be of benefit in the treatment of bladder cancer.

Panel 4D Summary: Ag2423 The expression of this gene is highest and almost exclusive to primary activated Th2 cells (CT 32.6). Very low expression of this transcript is found in activated LPS and macrophages (CT 34.9). This transcript encodes for a 26s proteasome like protein which is an essential component of the cellular protein degradation machinery. Some studies (reference 1) indicate a potential role for proteasomes in the regulation of signal transduction in T and B lymphocytes. This novel 26S proteasome may be involved in a more specific Th2 signalling pathway. Therefore, this gene product may be useful as a potential therapeutic target for attenuation of hyperactive Th2 response such as observed in allergic diseases (rhinitis, atopic skin diseases, asthma).

References:

Biochim Biophys Acta 1999 Jan. 6;1453(1):92–104 Proteasome participates in the alteration of signal transduction in T and B lymphocytes following trauma-hemorrhage. Samy T S, Schwacha M G, Chung C S, Cioffi W G, Bland K I, Chaudry I H.

Department of Surgery, Brown University School of Medicine, Providence, R.I., USA.

Proteasomes are essential components of the cellular protein degradation machinery. They are nonlysosomal and their participation is critical for (1) the removal of short lived proteins involved in metabolic regulation and cell proliferation, (2) the control of the activities of regulators involved in gene transcription, such as nuclear factor-kappa B (NF-kappa B) and signal transducer and activator of transcription (STAT1), and (3) processing of antigenic peptides for MHC class I presentation. Trauma-hemorrhage induces profound immunosuppression which is characterized by reduced splenocyte proliferation, interleukin (IL)-2 and interferon (IFN)-gamma productive capacity, increased activation of transcription factors NF-kappa B and STAT1 in splenic T lymphocytes, reduced macrophage antigen presentation capacity and inordinate release of proinflammatory cytokines, such as IL-6 and tumor necrosis factor-alpha. Furthermore, it appears that the activity of several regulatory proteins involved in immune function is altered by trauma-hemorrhage. Since proteasomes are involved in regulation and removal of regulatory proteins, we hypothesized that trauma-hemorrhage alters proteasomal activity in splenic lymphocytes. The data showed that activities of 26s proteasome from CD3+CD4+ and CD3+CD8+ splenic T lymphocytes were enhanced following trauma-hemorrhage which was associated with increased expression of NF-kappa B and STAT1. On the other hand, trauma-hemorrhage attenuated the activity of 26s proteasome from splenic B lymphocytes which was restored upon IFN-gamma stimulation and correlated with increased expression of NF-kappa B. These studies indicate a potential role for proteasomes in the regulation of signal transduction in splenic T and B lymphocytes following trauma-hemorrhage, and also suggest them as potential therapeutic targets for attenuation of immune suppression associated with this form of injury.

NOV6

Expression of gene NOV6 was assessed using the primer-probe sets Ag1508, Ag1586, Ag2011 and Ag2284, described in Tables 45, 46, 47 and 48. Results of the RTQ-PCR runs are shown in Tables 49, 50, 51, 52, 53 and 54.

TABLE 45

Probe Name Ag1508

| Primers | Sequences | Length | Start Position | SEQ ID NO: |
|---|---|---|---|---|
| Forward | 5'-atttggctatcccttcaggtt-3' | 21 | 238 | 160 |
| Probe | TET-5'-cggatccaatatgagatgccctct-3'-TAMRA | 25 | 263 | 161 |
| Reverse | 5'-gtcttggagctggactcttcat-3' | 22 | 291 | 162 |

TABLE 46

Probe Name Ag1586

| Primers | Sequences | Length | Start Position | SEQ ID NO: |
|---|---|---|---|---|
| Forward | 5'-accaggatgagtttgtgtcatc-3' | 22 | 1583 | 163 |
| Probe | TET-5'-ctcaagatcccttcggacacgctgt-3'-TAMRA | 25 | 1609 | 164 |
| Reverse | 5'-tgcggaagctgtacacatagta-3' | 22 | 1657 | 165 |

TABLE 47

Probe Name Ag2011

| Primers | Sequences | Length | Start Position | SEQ ID NO: |
|---|---|---|---|---|
| Forward | 5'-accaggatgagtttgtgtcatc-3' | 22 | 1583 | 166 |
| Probe | TET-5'-ctcaagatcccttcggacacgct-3'-TAMRA | 25 | 1609 | 167 |
| Reverse | 5'-tgcggaagctgtacacatagta-3' | 22 | 1657 | 168 |

TABLE 48

Probe Name Ag2284

| Primers | Sequences | Length | Start Position | SEQ ID NO" |
|---|---|---|---|---|
| Forward | 5'-tagttatctacctgcgcttcca-3' | 22 | 399 | 169 |
| Probe | TET-5'-tctacacagagaacaaacgcttcccg-3'-TAMRA | 26 | 426 | 170 |
| Reverse | 5'-gaaggtgaaggagacagtcaca-3' | 22 | 466 | 171 |

TABLE 49

Panel 1.2

| Tissue Name | Rel. Exp. (%) Ag1508, Run 141937122 | Tissue Name | Rel. Exp. (%) Ag1508, Run 141937122 |
|---|---|---|---|
| Endothelial cells | 0.0 | Renal ca. 786-0 | 0.0 |
| Heart (Fetal) | 0.9 | Renal ca. A498 | 0.0 |
| Pancreas | 0.1 | Renal ca. RXF 393 | 0.0 |
| Pancreatic ca. CAPAN 2 | 0.0 | Renal ca. ACHN | 0.0 |
| Adrenal Gland | 2.7 | Renalca. UO-31 | 0.0 |
| Thyroid | 0.1 | Renal ca. TK-10 | 0.0 |
| Salivary gland | 0.9 | Liver | 0.3 |
| Pituitary gland | 0.0 | Liver (fetal) | 0.1 |
| Brain (fetal) | 0.0 | Liver ca. (hepatoblast) HepG2 | 0.0 |
| Brain (whole) | 0.0 | Lung | 0.0 |
| Brain (amygdala) | 0.0 | Lung (fetal) | 0.0 |
| Brain (cerebellum) | 0.1 | Lung ca. (small cell) LX-1 | 0.0 |
| Brain (hippocampus) | 0.1 | Lung ca. (small cell) NCI-H69 | 0.0 |
| Brain (thalamus) | 0.0 | Lung ca. (s.cell var.) SHP-77 | 0.0 |
| Cerebral Cortex | 0.3 | Lung ca. (large cell)NCI-H460 | 0.0 |
| Spinal cord | 0.0 | Lung ca. (non-sm. cell) A549 | 0.0 |
| glio/astro U87-MG | 0.0 | Lung ca. (non-s.cell) NCI-H23 | 0.0 |
| glio/astro U-118-MG | 0.1 | Lung ca. (non-s.cell) HOP-62 | 0.0 |
| astrocytoma SW1783 | 0.0 | Lung ca. (non-s.cl) NCI-H522 | 9.4 |
| neuro*; met SK-N-AS | 0.0 | Lung ca. (squam.) SW 900 | 0.2 |
| astrocytoma SF-539 | 0.0 | Lung ca. (squam.) NCI-H596 | 0.0 |
| astrocytoma SNB-75 | 0.0 | Mammary gland | 0.0 |
| glioma SNB-19 | 0.0 | Breast ca.* (pl.ef) MCF-7 | 0.0 |
| glioma U251 | 0.0 | Breast ca.* (pl.ef) MDA-MB-231 | 0.0 |
| glioma SF-295 | 0.0 | Breast ca.* (pl. ef) T47D | 0.0 |
| Heart | 10.7 | Breast ca. BT-549 | 0.0 |
| Skeletal Muscle | 100.0 | Breast ca. MDA-N | 0.0 |
| Bone marrow | 0.1 | Ovary | 0.5 |
| Thymus | 0.0 | Ovarian ca. OVCAR-3 | 0.0 |
| Spleen | 0.0 | Ovarian ca. OVCAR-4 | 0.0 |
| Lymph node | 0.0 | Ovarian ca. OVCAR-5 | 0.0 |
| Colorectal | 0.0 | Ovarian ca. OVCAR-8 | 0.0 |
| Stomach | 0.1 | Ovarian ca. IGROV-1 | 0.0 |
| Small intestine | 0.2 | Ovarian ca. (ascites) SK-OV-3 | 0.0 |
| Colon ca. SW480 | 0.0 | Uterus | 0.2 |
| Colon ca.* SW620 (SW480 met) | 0.0 | Placenta | 0.0 |
| Colon ca. HT29 | 0.0 | Prostate | 0.4 |
| Colon ca. HCT-116 | 0.1 | Prostate ca.* (bone met) PC-3 | 0.0 |
| Colon ca. CaCo-2 | 0.0 | Testis | 0.2 |
| CC Well to Mod Diff (ODO3866) | 0.0 | Melanoma Hs688(A).T | 0.0 |
| Colon ca. HCC-2998 | 0.0 | Melanoma* (met) Hs688(B).T | 0.0 |
| Gastric ca. (liver met) NCI-N87 | 0.0 | Melanoma UACC-62 | 0.1 |
| Bladder | 0.2 | Melanoma M14 | 0.0 |
| Trachea | 0.0 | Melanoma LOX IMVI | 0.0 |
| Kidney | 8.9 | Melanoma* (met) SK-MEL-5 | 0.0 |
| Kidney (fetal) | 0.6 | | |

TABLE 50

Panel 1.3D

| Tissue Name | Rel. Exp. (%) Ag1586, Run 146473155 | Rel. Exp. (%) Ag2011, Run 147816085 | Rel. Exp. (%) Ag2284, Run 167985231 | Tissue Name | Rel. Exp. (%) Ag2586, Run 146473155 | Rel. Exp. (%) Ag2011, Run 147816085 | Rel. Exp. (%) Ag2284, Run 167985231 |
|---|---|---|---|---|---|---|---|
| Liver adenocarcinoma | 29.9 | 37.6 | 0.2 | Kidney (fetal) | 3.8 | 3.7 | 1.6 |
| Pancreas | 1.7 | 0.7 | 0.3 | Renal ca. 786-0 | 6.1 | 11.7 | 0.0 |
| Pancreatic ca. CAPAN 2 | 6.3 | 9.6 | 0.0 | Renal ca. A498 | 25.0 | 25.9 | 0.0 |
| Adrenal gland | 2.6 | 2.5 | 0.5 | Renal ca. RXF 393 | 4.5 | 5.0 | 0.0 |
| Thyroid | 2.5 | 1.8 | 1.2 | Renal ca. ACHN | 8.8 | 11.3 | 0.0 |
| Salivary gland | 1.9 | 2.2 | 0.4 | Renal ca. UO-31 | 15.0 | 15.0 | 0.0 |
| Pituitary gland | 0.9 | 1.5 | 0.1 | Renal ca. TK-10 | 4.4 | 4.6 | 0.0 |
| Brain (fetal) | 12.2 | 13.1 | 0.0 | Liver | 0.2 | 0.1 | 0.4 |
| Brain (whole) | 9.7 | 10.7 | 0.2 | Liver (fetal) | 0.7 | 0.8 | 0.1 |
| Brain (amygdala) | 9.5 | 9.9 | 0.2 | Liver ca. (hepatoblast) HepG2 | 16.8 | 12.8 | 0.1 |
| Brain (cerebellum) | 3.3 | 2.3 | 0.1 | Lung | 5.0 | 5.1 | 0.0 |
| Brain (hippocampus) | 24.7 | 21.0 | 0.1 | Lung (fetal) | 7.4 | 8.1 | 0.1 |
| Brain (substantia nigra) | 0.9 | 1.3 | 0.1 | Lung ca. (small cell) LX-1 | 16.8 | 12.1 | 0.0 |
| Brain (thalamus) | 4.7 | 3.7 | 0.1 | Lung ca. (small cell) NCI-H69 | 18.4 | 23.7 | 0.0 |
| Cerebral Cortex | 75.8 | 71.2 | 0.2 | Lung ca. (s. cell var.) SHP-77 | 8.5 | 7.2 | 0.0 |
| Spinal cord | 2.0 | 2.4 | 0.1 | Lung ca. (large cell) NCI-H460 | 10.7 | 10.1 | 0.0 |
| glio/astro U87-MG | 15.3 | 17.9 | 0.0 | Lung ca. (non-sm. cell) A549 | 3.2 | 4.1 | 0.0 |
| glio/astro U-118-MG | 38.2 | 41.2 | 0.2 | Lung ca. (non-s. cell) NCI-H23 | 23.2 | 24.7 | 0.5 |
| astrocytoma SW1783 | 8.3 | 10.4 | 0.1 | Lung ca. (non-s. cell) HOP-62 | 18.9 | 15.7 | 0.0 |
| neuro*; met SK-N-AS | 23.5 | 24.3 | 0.0 | Lung ca. (non-s. cl) NCI-H522 | 5.6 | 7.5 | 8.1 |
| astrocytoma SF-539 | 19.6 | 38.4 | 0.0 | Lung ca. (squam.) SW 900 | 13.0 | 13.1 | 0.2 |
| astrocytoma SNB-75 | 44.4 | 45.1 | 0.1 | Lung ca. (squam.) NCI-H596 | 6.5 | 5.7 | 0.0 |
| glioma SNB-19 | 26.2 | 12.2 | 0.0 | Mammary gland | 11.5 | 9.3 | 0.2 |
| glioma U251 | 16.4 | 16.2 | 0.1 | Breast ca.* (pl. ef) MCF-7 | 14.1 | 14.4 | 0.0 |
| glioma SF-295 | 26.4 | 36.9 | 0.0 | Breast ca.* (pl. ef) MDA-MB-231 | 82.9 | 87.1 | 0.0 |
| Heart (Fetal) | 80.7 | 95.3 | 1.8 | Breast ca.* (pl. ef) T47D | 6.1 | 4.6 | 0.1 |
| Heart | 2.8 | 1.9 | 2.3 | Breast ca. BT-549 | 13.6 | 11.2 | 0.2 |
| Skeletal muscle (Fetal) | 85.3 | 87.7 | 100.0 | Breast ca. MDA-N | 28.1 | 31.6 | 0.0 |
| Skeletal muscle | 2.1 | 2.4 | 88.3 | Ovary | 20.9 | 19.5 | 0.8 |
| Bone marrow | 0.6 | 0.3 | 0.2 | Ovarian ca. OVCAR-3 | 33.0 | 40.1 | 0.0 |

TABLE 50-continued

Panel 1.3D

| Tissue Name | Rel. Exp. (%) Ag1586, Run 146473155 | Rel. Exp. (%) Ag2011, Run 147816085 | Rel. Exp. (%) Ag2284, Run 167985231 | Tissue Name | Rel. Exp. (%) Ag2586, Run 146473155 | Rel. Exp. (%) Ag2011, Run 147816085 | Rel. Exp. (%) Ag2284, Run 167985231 |
|---|---|---|---|---|---|---|---|
| Thymus | 2.6 | 2.3 | 0.0 | Ovarian ca. OVCAR-4 | 5.5 | 5.4 | 0.0 |
| Spleen | 2.9 | 2.6 | 0.0 | Ovarian ca. OVCAR-5 | 10.9 | 13.1 | 0.1 |
| Lymph node | 5.1 | 5.2 | 0.1 | Ovarian ca. OVCAR-8 | 17.4 | 18.3 | 0.1 |
| Colorectal | 5.2 | 3.9 | 0.0 | Ovarian ca. IGROV-1 | 4.5 | 5.3 | 0.0 |
| Stomach | 3.7 | 5.6 | 0.2 | Ovarian ca. (ascites) SK-OV-3 | 25.7 | 22.4 | 0.1 |
| Small intestine | 1.6 | 1.3 | 0.2 | Uterus | 2.7 | 2.4 | 1.0 |
| Colon ca. SW480 | 45.4 | 55.5 | 0.1 | Placenta | 6.7 | 10.2 | 0.2 |
| Colon ca.* SW620 (SW480 met) | 11.3 | 11.1 | 0.0 | Prostate | 0.4 | 1.4 | 0.2 |
| Colon ca. HT29 | 13.3 | 13.3 | 0.0 | Prostate ca.* (bone met) PC-3 | 8.4 | 11.3 | 0.0 |
| Colon ca. HCT-116 | 10.5 | 10.5 | 0.2 | Testis | 8.1 | 8.5 | 1.1 |
| Colon ca. CaCo-2 | 24.0 | 23.0 | 0.1 | Melanoma Hs688(A).T | 59.0 | 86.5 | 0.0 |
| CC Well to Mod Diff (ODO3866) | 19.1 | 16.6 | 0.1 | Melanoma* (met) Hs688(B).T | 100.0 | 100.0 | 0.0 |
| Colon ca. HCC-2998 | 25.7 | 20.3 | 0.0 | Melanoma UACC-62 | 17.6 | 19.5 | 0.1 |
| Gastric ca. (liver met) NCI-N87 | 59.9 | 62.9 | 0.1 | Melanoma M14 | 16.3 | 21.9 | 0.0 |
| Bladder | 1.8 | 4.6 | 0.2 | Melanoma LOX IMVI | 3.6 | 5.8 | 0.0 |
| Trachea | 6.9 | 5.6 | 0.1 | Melanoma* (met) SK-MEL-5 | 12.9 | 22.1 | 0.0 |
| Kidney | 0.8 | 0.7 | 2.8 | Adipose | 5.6 | 4.5 | 0.7 |

TABLE 51

Panel 2.2

| Tissue Name | Rel. Exp. (%) Ag2011, Run 174154748 | Tissue Name | Rel. Exp. (%) Ag2011, Run 174154748 |
|---|---|---|---|
| Normal Colon | 24.7 | Kidney Margin (OD04348) | 68.3 |
| Colon cancer (OD06064) | 48.6 | Kidney malignant cancer (OD06204B) | 25.0 |
| Colon Margin (OD06064) | 4.9 | Kidney normal adjacent tissue (OD06204E) | 7.4 |
| Colon cancer (OD06159) | 9.3 | Kidney Cancer (OD04450-01) | 34.4 |
| Colon Margin (OD06159) | 19.5 | Kidney Margin (OD04450-03) | 18.4 |
| Colon cancer (OD06297-04) | 11.7 | Kidney Cancer 8120613 | 9.7 |
| Colon Margin (OD06297-015) | 12.5 | Kidney Margin 8120614 | 18.8 |
| CC Gr.2 ascend colon (ODO3921) | 17.3 | Kidney Cancer 9010320 | 16.2 |
| CC Margin (ODO3921) | 14.2 | Kidney Margin 9010321 | 13.8 |
| Colon cancer metastasis (OD06104) | 8.6 | Kidney Cancer 8120607 | 37.1 |
| Lung Margin (OD06104) | 8.3 | Kidney Margin 8120608 | 7.0 |
| Colon mets to lung (OD04451-01) | 23.0 | Normal Uterus | 21.9 |

TABLE 51-continued

Panel 2.2

| Tissue Name | Rel. Exp. (%) Ag2011, Run 174154748 | Tissue Name | Rel. Exp. (%) Ag2011, Run 174154748 |
|---|---|---|---|
| Lung Margin (OD04451-02) | 32.8 | Uterine Cancer 064011 | 13.7 |
| Normal Prostate | 4.8 | Normal Thyroid | 2.4 |
| Prostate Cancer (OD04410) | 4.9 | Thyroid Cancer | 8.1 |
| Prostate Margin (OD04410) | 8.8 | Thyroid Cancer A302152 | 35.4 |
| Normal Ovary | 32.3 | Thyroid Margin A302153 | 8.7 |
| Ovarian cancer (OD06283-03) | 32.1 | Normal Breast | 29.7 |
| Ovarian Margin (OD06283-07) | 13.8 | Breast Cancer | 11.9 |
| Ovarian Cancer | 19.9 | Breast Cancer | 47.6 |
| Ovarian cancer (OD06145) | 9.2 | Breast Cancer (OD04590-01) | 25.5 |
| Ovarian Margin (OD06145) | 8.6 | Breast Cancer Mets (OD04590-03) | 38.4 |
| Ovarian cancer (OD06455-03) | 13.0 | Breast Cancer Metastasis | 30.1 |
| Ovarian Margin (OD06455-07) | 2.1 | Breast Cancer | 41.5 |
| Normal Lung | 27.2 | Breast Cancer 9100266 | 9.2 |
| Invasive poor diff. lung adeno (ODO4945-01) | 28.5 | Breast Margin 9100265 | 18.2 |
| Lung Margin (ODO4945-03) | 15.0 | Breast Cancer A209073 | 14.9 |
| Lung Malignant Cancer (OD03126) | 30.4 | Breast Margin A2090734 | 37.6 |
| Lung Margin (OD03126) | 15.9 | Breast cancer (OD06083) | 55.9 |
| Lung Cancer (OD05014A) | 39.5 | Breast cancer node metastasis (OD06083) | 48.6 |
| Lung Margin (OD05014B) | 22.1 | Normal Liver | 10.4 |
| Lung cancer (OD06081) | 23.7 | Liver Cancer 1026 | 9.1 |
| Lung Margin (OD06081) | 16.8 | Liver Cancer 1025 | 20.7 |
| Lung Cancer (OD04237-01) | 9.0 | Liver Cancer 6004-T | 12.2 |
| Lung Margin (OD04237-02) | 41.5 | Liver Tissue 6004-N | 8.0 |
| Ocular Mel Met to Liver (ODO4310) | 100.0 | Liver Cancer 6005-T | 36.6 |
| Liver Margin (ODO4310) | 4.2 | Liver Tissue 6005-N | 25.0 |
| Melanoma Metastasis | 47.0 | Liver Cancer | 4.5 |
| Lung Margin (OD04321) | 28.1 | Normal Bladder | 18.7 |
| Normal Kidney | 12.3 | Bladder Cancer | 17.2 |
| Kidney Ca, Nuclear grade 2 (OD04338) | 18.3 | Bladder Cancer | 72.7 |
| Kidney Margin (OD04338) | 18.0 | Normal Stomach | 33.4 |
| Kidney Ca Nuclear grade 1/2 (OD04339) | 83.5 | Gastric Cancer 9060397 | 9.6 |
| Kidney Margin (OD04339) | 10.4 | Stomach Margin 9060396 | 10.4 |
| Kidney Ca, Clear cell type (OD04340) | 22.2 | Gastric Cancer 9060395 | 7.6 |
| Kidney Margin (OD04340) | 12.7 | Stomach Margin 9060394 | 19.6 |
| Kidney Ca, Nuclear grade 3 (OD04348) | 15.7 | Gastric Cancer 064005 | 17.4 |

TABLE 52

Panel 2D

| Tissue Name | Rel. Exp. (%) Ag1508, Run 144982575 | Rel. Exp. (%) Ag1586, Run 162624476 | Tissue Name | Rel. Exp. (%) Ag1508, Run 144982575 | Rel. Exp. (%) Ag1586, Run 162624476 |
|---|---|---|---|---|---|
| Normal Colon | 2.2 | 34.9 | Kidney Margin 8120608 | 11.3 | 14.2 |

TABLE 52-continued

Panel 2D

| Tissue Name | Rel. Exp. (%) Ag1508, Run 144982575 | Rel. Exp. (%) Ag1586, Run 162624476 | Tissue Name | Rel. Exp. (%) Ag1508, Run 144982575 | Rel. Exp. (%) Ag1586, Run 162624476 |
|---|---|---|---|---|---|
| CC Well to Mod Diff (ODO3866) | 0.1 | 28.3 | Kidney Cancer 8120613 | 3.6 | 30.4 |
| CC Margin (ODO3866) | 1.4 | 9.2 | Kidney Margin 8120614 | 11.0 | 17.7 |
| CC Gr.2 rectosigmoid (ODO3868) | 0.1 | 25.9 | Kidney Cancer 9010320 | 0.7 | 57.0 |
| CC Margin (ODO3868) | 0.6 | 4.7 | Kidney Margin 9010321 | 12.0 | 40.9 |
| CC Mod Diff (ODO3920) | 0.1 | 55.5 | Normal Uterus | 2.8 | 10.4 |
| CC Margin (ODO3920) | 1.1 | 14.2 | Uterine Cancer 064011 | 0.6 | 28.9 |
| CC Gr.2 ascend colon (ODO3921) | 0.1 | 62.9 | Normal Thyroid | 15.1 | 8.4 |
| CC Margin (ODO3921) | 0.6 | 12.1 | Thyroid Cancer | 7.1 | 16.7 |
| CC from Partial Hepatectomy (ODO4309) Mets | 0.3 | 41.5 | Thyroid Cancer A302152 | 0.9 | 24.7 |
| Liver Margin (ODO4309) | 2.4 | 13.6 | Thyroid Margin A302153 | 3.1 | 17.7 |
| Colon mets to lung (OD04451-01) | 0.2 | 18.0 | Normal Breast | 0.3 | 60.3 |
| Lung Margin (OD04451-02) | 0.4 | 25.5 | Breast Cancer | 0.0 | 24.1 |
| Normal Prostate 6546-1 | 3.3 | 17.0 | Breast Cancer (OD04590-01) | 0.2 | 47.0 |
| Prostate Cancer (OD04410) | 3.4 | 33.7 | Breast Cancer Mets (OD04590-03) | 0.7 | 72.7 |
| Prostate Margin (OD04410) | 0.5 | 28.9 | Breast Cancer Metastasis | 0.0 | 37.4 |
| Prostate Cancer (OD04720-01) | 0.3 | 33.7 | Breast Cancer | 0.2 | 36.9 |
| Prostate Margin (OD04720-02) | 2.6 | 45.7 | Breast Cancer | 0.1 | 65.1 |
| Normal Lung | 0.7 | 80.7 | Breast Cancer 9100266 | 0.4 | 39.8 |
| Lung Met to Muscle (ODO4286) | 0.3 | 100.0 | Breast Margin 9100265 | 0.3 | 31.2 |
| Muscle Margin (ODO4286) | 100.0 | 21.5 | Breast Cancer A209073 | 0.2 | 49.0 |
| Lung Malignant Cancer (OD03126) | 0.3 | 57.8 | Breast Margin A2090734 | 0.0 | 44.8 |
| Lung Margin (OD03126) | 0.4 | 61.6 | Normal Liver | 1.6 | 4.5 |
| Lung Cancer (OD04404) | 0.1 | 70.2 | Liver Cancer | 0.9 | 2.6 |
| Lung Margin (OD04404) | 0.3 | 34.2 | Liver Cancer 1025 | 1.1 | 4.7 |
| Lung Cancer (OD04565) | 0.0 | 87.7 | Liver Cancer 1026 | 1.0 | 18.3 |
| Lung Margin (OD04565) | 0.8 | 23.8 | Liver Cancer 6004-T | 2.3 | 7.6 |
| Lung Cancer (OD04237-01) | 0.2 | 41.5 | Liver Tissue 6004-N | 0.3 | 12.0 |
| Lung Margin (OD04237-02) | 0.5 | 34.2 | Liver Cancer 6005-T | 0.7 | 12.1 |
| Ocular Mel Met to Liver (ODO4310) | 1.3 | 97.3 | Liver Tissue 6005-N | 1.6 | 5.7 |
| Liver Margin (OD04310) | 3.2 | 5.0 | Normal Bladder | 0.9 | 38.2 |
| Melanoma Metastasis | 0.0 | 87.7 | Bladder Cancer | 0.0 | 21.3 |
| Lung Margin (OD04321) | 0.6 | 56.3 | Bladder Cancer | 0.1 | 46.0 |
| Normal Kidney | 18.8 | 30.1 | Bladder Cancer (OD04718-01) | 0.2 | 96.6 |
| Kidney Ca, Nuclear grade 2 | 7.5 | 46.7 | Bladder Normal Adjacent | 2.9 | 29.5 |

TABLE 52-continued

Panel 2D

| Tissue Name | Rel. Exp. (%) Ag1508, Run 144982575 | Rel. Exp. (%) Ag1586, Run 162624476 | Tissue Name | Rel. Exp. (%) Ag1508, Run 144982575 | Rel. Exp. (%) Ag1586, Run 162624476 |
|---|---|---|---|---|---|
| (OD04338) | | | (OD04718-03) | | |
| Kidney Margin (OD04338) | 6.0 | 14.8 | Normal Ovary | 1.1 | 21.5 |
| Kidney Ca Nuclear grade 1/2 (OD04339) | 11.3 | 52.1 | Ovarian Cancer | 0.3 | 73.7 |
| Kidney Margin (OD04339) | 14.2 | 20.3 | Ovarian Cancer (OD04768-07) | 0.0 | 48.3 |
| Kidney Ca, Clear cell type (OD04340) | 2.5 | 49.0 | Ovary Margin (OD04768-08) | 0.2 | 18.8 |
| Kidney Margin (OD04340) | 11.4 | 23.2 | Normal Stomach | 0.9 | 13.9 |
| Kidney Ca, Nuclear grade 3 (OD04348) | 0.9 | 42.6 | Gastric Cancer 9060358 | 0.3 | 6.7 |
| Kidney Margin (OD04348) | 9.3 | 28.9 | Stomach Margin 9060359 | 0.3 | 13.2 |
| Kidney Cancer (OD04622-01) | 0.4 | 50.7 | Gastric Cancer 9060395 | 1.3 | 28.3 |
| Kidney Margin (OD04622-03) | 1.7 | 8.6 | Stomach Margin 9060394 | 0.4 | 18.0 |
| Kidney Cancer (OD04450-01) | 6.2 | 21.8 | Gastric Cancer 9060397 | 0.4 | 45.4 |
| Kidney Margin (OD04450-03) | 6.1 | 18.2 | Stomach Margin 9060396 | 0.0 | 10.4 |
| Kidney Cancer 8120607 | 0.9 | 25.0 | Gastric Cancer 064005 | 0.5 | 48.3 |

TABLE 53

Panel 4.1D

| Tissue Name | Rel. Exp. (%) Ag2284, Run 170069125 | Tissue Name | Rel. Exp. (%) Ag2284, Run 170069125 |
|---|---|---|---|
| Secondary Th1 act | 0.0 | HUVEC IL-1beta | 0.0 |
| Secondary Th2 act | 1.0 | HUVEC IFN gamma | 0.0 |
| Secondary Tr1 act | 0.0 | HUVEC TNF alpha + IFN gamma | 0.0 |
| Secondary Th1 rest | 0.7 | HUVEC TNF alpha + IL4 | 0.0 |
| Secondary Th2 rest | 0.5 | HUVEC IL-11 | 0.0 |
| Secondary Tr1 rest | 0.0 | Lung Microvascular EC none | 0.0 |
| Primary Th1 act | 0.0 | Lung Microvascular EC TNFalpha + IL-1beta | 0.0 |
| Primary Th2 act | 0.7 | Microvascular Dermal EC none | 0.0 |
| Primary Tr1 act | 0.0 | Microsvasular Dermal EC TNFalpha + IL-1beta | 0.0 |
| Primary Th1 rest | 0.0 | Bronchial epithelium TNFalpha + IL1beta | 1.0 |
| Primary Th2 rest | 0.0 | Small airway epithelium none | 0.0 |
| Primary Tr1 rest | 0.0 | Small airway epithelium TNFalpha + IL-1beta | 0.0 |
| CD45RA CD4 lymphocyte act | 7.5 | Coronery artery SMC rest | 0.0 |
| CD45RO CD4 lymphocyte act | 0.0 | Coronery artery SMC TNFalpha + IL-1beta | 0.0 |
| CD8 lymphocyte act | 0.0 | Astrocytes rest | 1.9 |
| Secondary CD8 lymphocyte rest | 0.0 | Astrocytes TNFalpha + IL-1beta | 3.2 |
| Secondary CD8 lymphocyte act | 0.0 | KU-812 (Basophil) rest | 0.0 |
| CD4 lymphocyte none | 0.0 | KU-812 (Basophil) PMA/ionomycin | 0.9 |

TABLE 53-continued

Panel 4.1D

| Tissue Name | Rel. Exp. (%) Ag2284, Run 170069125 | Tissue Name | Rel. Exp. (%) Ag2284, Run 170069125 |
|---|---|---|---|
| 2ry Th1/Th2/Tr1_anti-CD95 CH11 | 1.2 | CCD1106 (Keratinocytes) none | 0.0 |
| LAK cells rest | 0.8 | CCD1106 (Keratinocytes) TNFalpha + IL-1beta | 0.0 |
| LAK cells IL-2 | 0.0 | Liver cirrhosis | 2.2 |
| LAK cells IL-2 + IL-12 | 0.4 | NCI-H292 none | 0.8 |
| LAK cells IL-2 + IFN gamma | 0.0 | NCI-H292 IL-4 | 0.0 |
| LAK cells IL-2 + IL-18 | 0.0 | NCI-H292 IL-9 | 0.0 |
| LAK cells PMA/ionomycin | 1.5 | NCI-H292 IL-13 | 0.0 |
| NK Cells IL-2 rest | 1.3 | NCI-H292 IFN gamma | 0.0 |
| Two Way MLR 3 day | 1.3 | HPAEC none | 0.0 |
| Two Way MLR 5 day | 1.8 | HPAEC TNF alpha + IL-1 beta | 0.0 |
| Two Way MLR 7 day | 0.0 | Lung fibroblast none | 27.9 |
| PBMC rest | 0.0 | Lung fibroblast TNF alpha + IL-1 beta | 4.7 |
| PBMC PWM | 0.9 | Lung fibroblast IL-4 | 19.3 |
| PBMC PHA-L | 0.0 | Lung fibroblast IL-9 | 32.3 |
| Ramos (B cell) none | 0.0 | Lung fibroblast IL-13 | 11.4 |
| Ramos (B cell) ionomycin | 0.0 | Lung fibroblast IFN gamma | 9.9 |
| B lymphocytes PWM | 0.8 | Dermal fibroblast CCD1070 rest | 43.2 |
| B lymphocytes CD40L and IL-4 | 0.0 | Dermal fibroblast CCD1070 TNF alpha | 31.0 |
| EOL-1 dbcAMP | 0.0 | Dermal fibroblast CCD1070 IL-1 beta | 7.4 |
| EOL-1 dbcAMP PMA/ionomycin | 0.0 | Dermal fibroblast IFN gamma | 5.8 |
| Dendritic cells none | 0.0 | Dermal fibroblast IL-4 | 38.4 |
| Dendritic cells LPS | 0.5 | Dermal Fibroblasts rest | 24.7 |
| Dendritic cells anti-CD40 | 0.9 | Neutrophils TNFa + LPS | 0.0 |
| Monocytes rest | 0.0 | Neutrophils rest | 0.0 |
| Monocytes LPS | 2.4 | Colon | 1.0 |
| Macrophages rest | 8.9 | Lung | 7.3 |
| Macrophages LPS | 0.0 | Thymus | 3.1 |
| HUVEC none | 0.0 | Kidney | 100.0 |
| HUVEC starved | 0.0 | | |

TABLE 54

Panel 4D

| Tissue Name | Rel. Exp. (%) Ag2011, Run 160997385 | Tissue Name | Rel. Exp. (%) Ag2011, Run 16099738S |
|---|---|---|---|
| Secondary Th1 act | 4.7 | HUVEC IL-1beta | 2.0 |
| Secondary Th2 act | 6.4 | HUVEC IFN gamma | 4.0 |
| Secondary Tr1 act | 8.6 | HUVEC TNF alpha + IFN gamma | 5.0 |
| Secondary Th1 rest | 0.6 | HUVEC TNF alpha + IL4 | 8.4 |
| Secondary Th2 rest | 1.7 | HUVEC IL-11 | 3.5 |
| Secondary Tr1 rest | 1.7 | Lung Microvascular EC none | 13.0 |
| Primary Th1 act | 14.0 | Lung Microvascular EC TNFalpha + IL-1 beta | 15.3 |
| Primary Th2 act | 7.7 | Microvascular Dermal EC none | 23.2 |
| Primary Tr1 act | 12.9 | Microsvasular Dermal EC TNFalpha + IL-1 beta | 17.3 |
| Primary Th1 rest | 3.3 | Bronchial epithelium TNFalpha + IL1beta | 4.5 |
| Primary Th2 rest | 2.3 | Small airway epithelium none | 16.0 |
| Primary Tr1 rest | 2.0 | Small airway epithelium TNFalpha + IL-1beta | 100.0 |

TABLE 54-continued

Panel 4D

| Tissue Name | Rel. Exp. (%) Ag2011, Run 160997385 | Tissue Name | Rel. Exp. (%) Ag2011, Run 16099738S |
|---|---|---|---|
| CD45RA CD4 lymphocyte act | 6.5 | Coronery artery SMC rest | 15.7 |
| CD45RO CD4 lymphocyte act | 5.3 | Coronery artery SMC TNFalpha + IL-1beta | 11.1 |
| CD8 lymphocyte act | 3.3 | Astrocytes rest | 25.3 |
| Secondary CD8 lymphocyte rest | 7.2 | Astrocytes TNFalpha + IL-1beta | 21.6 |
| Secondary CD8 lymphocyte act | 3.0 | KU-812 (Basophil) rest | 8.4 |
| CD4 lymphocyte none | 1.6 | KU-812 (Basophil) PMA/ionomycin | 39.5 |
| 2ry Th1/Th2/Tr1_anti-CD95 CH11 | 0.3 | CCD1106 (Keratinocytes) none | 35.1 |
| LAK cells rest | 19.1 | CCD1106 (Keratinocytes) TNFalpha + IL-1beta | 5.9 |
| LAK cells IL-2 | 3.1 | Liver cirrhosis | 0.9 |
| LAK cells IL-2 + IL-12 | 6.5 | Lupus kidney | 1.3 |
| LAK cells IL-2 + IFN gamma | 9.8 | NCI-H292 none | 42.3 |
| LAK cells IL-2 + IL-18 | 5.9 | NCI-H292 IL-4 | 90.1 |
| LAK cells PMA/ionomycin | 8.7 | NCI-H292 IL-9 | 58.2 |
| NK Cells IL-2 rest | 1.7 | NCI-H292 IL-13 | 33.9 |
| Two Way MLR 3 day | 9.3 | NCI-H292 IFN gamma | 30.4 |
| Two Way MLR 5 day | 7.4 | HPAEC none | 5.8 |
| Two Way MLR 7 day | 2.0 | HPAEC TNF alpha + IL-1 beta | 12.9 |
| PBMC rest | 1.7 | Lung fibroblast none | 23.8 |
| PBMC PWM | 12.5 | Lung fibroblast TNF alpha + IL-1 beta | 10.7 |
| PBMC PHA-L | 5.4 | Lung fibroblast IL-4 | 59.0 |
| Ramos (B cell) none | 0.5 | Lung fibroblast IL-9 | 40.6 |
| Ramos (B cell) ionomycin | 0.9 | Lung fibroblast IL-13 | 31.0 |
| B lymphocytes PWM | 15.6 | Lung fibroblast IFN gamma | 65.5 |
| B lymphocytes CD40L and IL-4 | 5.8 | Dermal fibroblast CCD1070 rest | 37.4 |
| EOL-1 dbcAMP | 3.5 | Dermal fibroblast CCD1070 TNF alpha | 50.0 |
| EOL-1 dbcAMP PMA/ionomycin | 60.3 | Dermal fibroblast CCD1070 IL-1 beta | 19.6 |
| Dendritic cells none | 17.6 | Dermal fibroblast IFN gamma | 15.0 |
| Dendritic cells LPS | 32.5 | Dermal fibroblast IL-4 | 43.8 |
| Dendritic cells anti-CD40 | 21.0 | IBD Colitis 2 | 0.3 |
| Monocytes rest | 0.1 | IBD Crohn's | 0.8 |
| Monocytes LPS | 8.4 | Colon | 5.3 |
| Macrophages rest | 34.2 | Lung | 15.0 |
| Macrophages LPS | 11.3 | Thymus | 5.8 |
| HUVEC none | 6.5 | Kidney | 11.4 |
| HUVEC starved | 9.3 | | |

Panel 1.2 Summary: Ag1508 The expression of the NOV6 gene is highest in a sample derived from skeletal muscle (CT=19.5). Thus, this gene could be used to distinguish skeletal muscle from other tissues. Expression of the NOV6 gene is also high in kidney (CT=23).

The NOV6 gene is also moderately expressed in other metabolically relevant tissues including heart, adrenal gland, pancreas, thyroid, pituitary gland, and liver (CT values from 29–32). The widespread expression of the NOV6 gene in tissues with metabolic function suggests a role in metabolic disorders such as obesity and diabetes.

The NOV6 gene is moderately expressed in the brain in at least the thalamus, hippocampus, cerebellum, amygdala and is highly expressed in the cerebral cortex, suggesting that this gene product has functional significance in the CNS. Please see Panel 1.3D for potential utility of this gene in the central nervous system.

Panel 1.3D Summary: Ag1586/2011/Ag2284 Two experiments with the same probe and primer set produce results that are in excellent agreement. The NOV6 gene appears to be expressed largely in cancer cell lines, with highest expression in a melanoma cell line (CTs=26–28). Of note is the expression associated with colon cancer cell lines and melanoma cell lines. Thus, the expression of thie gene could be used to distinguish these samples from other samples on the panel. Moreover, therapeutic modulation of this gene, through the use of small molecule drugs, antibodies or protein therapeutics might be of use in the treatment of colon cancer or melanoma.

The NOV6 gene is modestly expressed (CT values= 31–34) in a variety of metabolic tissues including pancreas, adrenal, thyroid, pituitary, fetal liver, and adipose. Thus, this gene product may be an antibody target for the treatment of metabolic disease, including obesity and diabetes, in any or all of these tissues. Furthermore, the NOV6 is expressed at higher levels in fetal (CT values=26–28) versus adult heart (CT values=31–33), and in fetal (CT values=26–28) versus adult skeletal muscle (CT values=32–33), and may be used to differentiate between the adult and fetal sources of these tissues. Furthermore, the higher levels of expression in the fetal tissues suggest that the NOV6 gene product may be involved in the development of heart and skeletal muscle tissue. Thus, therapeutic modulation of the expression or function of the protein encoded by the NOV6 gene may be beneficial in the treatment of diseases that result in weak or dystrophic heart or skeletal muscle tissue, including ardiomyopathy, atherosclerosis, hypertension, congenital heart defects, aortic stenosis, atrial septal defect (ASD), atrioventricular (A-V) canal defect, ductus arteriosus, pulmonary stenosis, subaortic stenosis, ventricular septal defect (VSD), valve diseases, muscular dystrophy, Lesch-Nyhan syndrome, and myasthenia gravis.

This gene represents a novel protein with homology to a plexin that is expressed at moderate to high levels in all brain regions examined. Plexins act as receptors for semaphorins in the CNS. The interactions of the semaphorins and their receptors are critical for axon guidance. Therefore, this gene product may be useful as a drug target in clinical conditions where axonal growth and/or compensatory synaptogenesis are desireable (spinal cord or head trauma, stroke, or neurodegenerative diseases such as Alzheimer's, Parkinson's, or Huntington's disease).

References:

1. Pasterkamp R J, Ruitenberg M J, Verhaagen J. Semaphorins and their receptors in olfactory axon guidance. Cell Mol Biol (Noisy-le-grand) 1999 September;45(6):763–79

The mammalian olfactory system is capable of discriminating among a large variety of odor molecules and is therefore essential for the identification of food, enemies and mating partners. The assembly and maintenance of olfactory connectivity have been shown to depend on the combinatorial actions of a variety of molecular signals, including extracellular matrix, cell adhesion and odorant receptor molecules. Recent studies have identified semaphorins and their receptors as putative molecular cues involved in olfactory pathfinding, plasticity and regeneration. The semaphorins comprise a large family of secreted and transmembrane axon guidance proteins, being either repulsive or attractive in nature. Neuropilins were shown to serve as receptors for secreted class 3 semaphorins, whereas members of the plexin family are receptors for class I and V (viral) semaphorins. The present review will discuss a role for semaphorins and their receptors in the establishment and maintenance of olfactory connectivity.

2. Murakami Y, Suto F, Shimizu M, Shinoda T, Kameyama T, Fujisawa H. Differential expression of plexin-A subfamily members in the mouse nervous system. Dev Dyn 2001 March;220(3):246–58

Plexins comprise a family of transmembrane proteins (the plexin family) which are expressed in nervous tissues. Some plexins have been shown to interact directly with secreted or transmembrane semaphorins, while plexins belonging to the A subfamily are suggested to make complexes with other membrane proteins, neuropilins, and propagate chemorepulsive signals of secreted semaphorins of class 3 into cells or neurons. Despite that much information has been gathered on the plexin-semaphorin interaction, the role of plexins in the nervous system is not well understood. To gain insight into the functions of plexins in the nervous system, we analyzed spatial and temporal expression patterns of three members of the plexin-A subfamily (plexin-A1, -A2, and -A3) in the developing mouse nervous system by in situ hybridization analysis in combination with immunohistochemistry. We show that the three plexins are differentially expressed in sensory receptors or neurons in a developmentally regulated manner, suggesting that a particular plexin or set of plexins is shared by neuronal elements and functions as the receptor for semaphorins to regulate neuronal development.

Panel 2.2 Summary: Ag2011 The expression of thie gene appears to be highest in a sample derived from a melanoma metastasis. In addition, there is substantial expression in another melanoma sample. This expression is concordant with the expression detected in Panel 1.3D. Thus, the expression of this gene could be used to distinguish melanoma from other cancer types in this panel. Moreover, therapeutic modulation of this gene, through the use of small molecule drugs, antibodies or protein therapeutics might be of use in the treatment of melanoma.

Panel 2D Summary: Ag1508/Ag1586 Expression of the SC126413398_A gene in this panel is highest in a sample of muscle tissue adjacent to a metastatic cancer and in a metastasis of lung cancer.

Panel 4.1D Summary: Ag2284 Significant expression in this panel is limited to kidney. This observation is consistent with what was observed in other panels. Therefore, therapuetic drugs designed against the SC126413398_A gene product may be important for regulating the function of the kidney.

Panel 4D Summary: Ag2011 Significant expression of this transcript is found in small airway epithelium upon treatment with the pro-inflammatory cytokines TNF-a and IL-1b (CT=26.5), the muco-epidermoid cell line H 292 treated with IL-4 or IL-9, and in lung fibroblasts treated with IFN-g or IL-4. The constitutive expression of this transcript in these tissues is highly up-regulated by pro-inflammatory cytokines or in conditions reflecting a Th2 mediated mechanism. Therefore, modulation of the expression of the protein encoded by this transcript could be useful for the treatment of lung inflammatory diseases that result from infection of the lung (bronchitis, pneumonia) and for the treatment of Th2—mediated lung disease such as asthma or COPD. Significant expression of this transcript is also found in eosinophils upon PMA and ionomycin treatment, conditions that lead to production of eosinophil specific mediators. This production could contribute to the pathologies associated with asthma, other atopic diseases and inflammatory bowel disease. This gene encodes a novel protein with homology to members of the plexin family, a family of transmembrane proteins which act as receptors for semaphorins. In neurons, semaphorins provide essential attractive and repulsive cues that are necessary for axon guidance. The description of the interaction of plexin wih tyrosine kinase in the fetal lung suggests that this protein may play a role not only in morphogenesis but also in proliferation of activation. (See reference below.) Therefore, modulation of the experession of this protein by either antibody or small molecules could be beneficial for the treatment of inflammatory lung, bowel and skin diseases.

References:

1. Cell 1999 Oct. 1;99(1):71–80

Plexins are a large family of receptors for transmembrane, secreted, and GPI-anchored semaphorins in vertebrates.

Tamagnone L, Artigiani S, Chen H, He Z, Ming G I, Song H, Chedotal A, Winberg M L, Goodman C S, Poo M, Tessier-Lavigne M, Comoglio P M.

Institute for Cancer Research and Treatment, University of Torino, Candiolo, Italy. ltamagnone@ircc.unito.it In *Drosophila*, plexin A is a functional receptor for semaphorin-1a. Here we show that the human plexin gene family comprises at least nine members in four subfamilies. Plexin-B1 is a receptor for the transmembrane semaphorin Sema4D (CDI10O), and plexin-C1 is a receptor for the GPI-anchored semaphorin Sema7A (Sema-K1). Secreted (class 3) semaphorins do not bind directly to plexins, but rather plexins associate with neuropilins, coreceptors for these semaphorins. Plexins are widely expressed: in neurons, the expression of a truncated plexin-A1 protein blocks axon repulsion by Sema3A. The cytoplasmic domain of plexins associates with a tyrosine kinase activity. Plexins may also act as ligands mediating repulsion in epithelial cells in vitro. We conclude that plexins are receptors for multiple (and perhaps all) classes of semaphorins, either alone or in combination with neuropilins, and trigger a novel signal transduction pathway controlling cell repulsion

PMID: 10520995

NOV7

Expression of gene NOV7 was assessed using the primer-probe sets Ag2262 and Ag2316, described in Tables 55 and 56. Results of the RTQ-PCR runs are shown in Tables 57, 58 and 59.

TABLE 55

Probe Name Ag2262

| Primers | Sequences | Length | Start Position | SEQ ID NO: |
|---|---|---|---|---|
| Forward | 5'-gacctggtgtacatggagga-3' | 20 | 761 | 172 |
| Probe | TET-5'-cttctgccggcccagcaagtact-3'-TAMRA | 23 | 790 | 173 |
| Reverse | 5'-gagcacaccctacctgctg-3' | 19 | 822 | 174 |

TABLE 56

Probe Name Ag2316

| Primers | Sequences | Length | Start Position | SEQ ID NO: |
|---|---|---|---|---|
| Forward | 5'-gtccaagagaggaaacaagga-3' | 21 | 457 | 175 |
| Probe | TET-5'-cacaatacccacgtgggcatcaag-3'-TAMRA | 24 | 500 | 176 |
| Reverse | 5'-gtcctgaggccactcttcac-3' | 20 | 527 | 177 |

TABLE 57

Panel 1.3D

| Tissue Name | Rel. Exp. (%) Ag2262, Run 150719071 | Rel. Exp. (%) Ag2262, Run 167966858 | Rel. Exp. (%) Ag2316, Run 162185396 | Tissue Name | Rel. Exp. (%) Ag2262, Run 150719071 | Rel. Exp. (%) Ag2262, Run 167966858 | Rel. Exp. (%) Ag2316, Run 162185396 |
|---|---|---|---|---|---|---|---|
| Liver adenocarcinoma | 0.0 | 6.7 | 0.0 | Kidney (fetal) | 24.0 | 100.0 | 50.0 |
| Pancreas | 0.0 | 0.0 | 0.0 | Renal ca. 786-0 | 0.0 | 0.0 | 0.0 |
| Pancreatic ca. CAPAN 2 | 0.0 | 0.0 | 0.0 | Renal ca. A498 | 0.0 | 12.6 | 0.0 |
| Adrenal gland | 1.9 | 0.0 | 0.0 | Renal ca. RXF 393 | 0.0 | 0.0 | 0.0 |
| Thyroid | 2.2 | 0.0 | 0.0 | Renal ca. ACHN | 0.0 | 0.0 | 0.0 |
| Salivary gland | 0.3 | 0.0 | 0.0 | Renal ca. UO-31 | 0.2 | 0.0 | 0.0 |
| Pituitary gland | 0.0 | 8.0 | 0.0 | Renal ca. TK-10 | 0.0 | 0.0 | 0.0 |
| Brain (fetal) | 0.0 | 1.0 | 0.0 | Liver | 0.0 | 0.0 | 0.0 |
| Brain (whole) | 5.2 | 0.0 | 26.2 | Liver (fetal) | 0.0 | 0.0 | 0.0 |
| Brain (amygdala) | 6.8 | 3.8 | 11.5 | Liver ca. (hepatoblast) HepG2 | 0.0 | 0.0 | 0.0 |
| Brain (cerebellum) | 1.0 | 6.4 | 0.0 | Lung | 6.8 | 0.0 | 19.3 |
| Brain (hippocampus) | 16.5 | 0.0 | 0.0 | Lung (fetal) | 8.5 | 0.0 | 6.8 |
| Brain (substantia nigra) | 2.0 | 0.0 | 0.0 | Lung ca. (small cell) LX-1 | 0.0 | 0.0 | 0.0 |

TABLE 57-continued

Panel 1.3D

| Tissue Name | Rel. Exp. (%) Ag2262, Run 150719071 | Rel. Exp. (%) Ag2262, Run 167966858 | Rel. Exp. (%) Ag2316, Run 162185396 | Tissue Name | Rel. Exp. (%) Ag2262, Run 150719071 | Rel. Exp. (%) Ag2262, Run 167966858 | Rel. Exp. (%) Ag2316, Run 162185396 |
|---|---|---|---|---|---|---|---|
| Brain (thalamus) | 4.9 | 11.2 | 57.0 | Lung ca. (small cell) NCI-H69 | 0.3 | 0.0 | 0.0 |
| Cerebral Cortex | 2.5 | 13.3 | 3.3 | Lung ca. (s. cell var.) SHP-77 | 2.5 | 6.9 | 0.0 |
| Spinal cord | 3.3 | 9.2 | 6.8 | Lung ca. (large cell)NCI-H460 | 0.0 | 0.0 | 0.0 |
| glio/astro U87-MG | 0.0 | 0.0 | 0.0 | Lung ca. (non-sm. cell) A549 | 0.0 | 6.4 | 0.0 |
| glio/astro U-118-MG | 0.0 | 0.0 | 0.0 | Lung ca. (non-s. cell) NCI-H23 | 0.0 | 0.0 | 0.0 |
| astrocytoma SW1783 | 0.0 | 0.0 | 0.0 | Lung ca. (non-s. cell) HOP-62 | 0.0 | 0.0 | 0.0 |
| neuro*; met SK-N-AS | 0.0 | 0.0 | 0.0 | Lung ca. (non-s. cl) NCI-H522 | 2.8 | 0.0 | 0.0 |
| astrocytoma SF-539 | 0.0 | 0.0 | 0.0 | Lung ca. (squam.) SW 900 | 0.0 | 0.0 | 0.0 |
| astrocytoma SNB-75 | 0.0 | 0.0 | 0.0 | Lung ca. (squam.) NCI-H596 | 0.0 | 0.0 | 0.0 |
| glioma SNB-19 | 0.0 | 0.0 | 0.0 | Mammary gland | 0.0 | 0.0 | 0.0 |
| glioma U251 | 0.0 | 0.0 | 0.0 | Breast ca.* (pl. ef) MCF-7 | 0.0 | 0.0 | 0.0 |
| glioma SF-295 | 0.0 | 0.0 | 0.0 | Breast ca.* (pl. ef) MDA-MB-231 | 0.0 | 0.0 | 0.0 |
| Heart (Fetal) | 2.0 | 0.0 | 33.4 | Breast ca.* (pl. ef) T47D | 0.0 | 0.0 | 0.0 |
| Heart | 0.0 | 6.7 | 9.6 | Breast ca. BT-549 | 0.0 | 0.0 | 0.0 |
| Skeletal muscle (Fetal) | 2.5 | 0.0 | 8.2 | Breast ca. MDA-N | 1.0 | 0.0 | 0.0 |
| Skeletal muscle | 0.0 | 0.0 | 0.0 | Ovary | 0.0 | 0.0 | 6.4 |
| Bone marrow | 0.9 | 0.0 | 0.0 | Ovarian ca. OVCAR-3 | 0.0 | 0.0 | 0.0 |
| Thymus | 0.0 | 0.0 | 0.0 | Ovarian ca. OVCAR-4 | 0.0 | 0.0 | 0.0 |
| Spleen | 100.0 | 65.5 | 100.0 | Ovarian ca. OVCAR-5 | 0.0 | 0.0 | 0.0 |
| Lymph node | 0.0 | 0.0 | 0.0 | Ovarian ca. OVCAR-8 | 0.0 | 0.0 | 0.0 |
| Colorectal | 10.8 | 19.8 | 0.0 | Ovarian ca. IGROV-1 | 0.0 | 0.0 | 0.0 |
| Stomach | 2.7 | 0.0 | 0.0 | Ovarian ca. (ascites) SK-OV-3 | 0.0 | 0.0 | 0.0 |
| Small intestine | 6.4 | 0.0 | 0.0 | Uterus | 0.0 | 0.0 | 0.0 |
| Colon ca. SW480 | 0.0 | 0.0 | 0.0 | Placenta | 0.6 | 7.1 | 0.0 |
| Colon ca.* SW620 (SW480 met) | 1.2 | 0.0 | 0.0 | Prostate | 0.0 | 1.8 | 4.9 |
| Colon ca. HT29 | 0.0 | 0.0 | 0.0 | Prostate ca.* (bone met) PC-3 | 0.0 | 0.0 | 0.0 |
| Colon ca. HCT-116 | 0.0 | 0.0 | 0.0 | Testis | 1.7 | 0.0 | 7.2 |
| Colon ca. CaCo-2 | 2.5 | 6.6 | 0.0 | Melanoma Hs688(A).T | 0.0 | 0.0 | 0.0 |
| CC Well to Mod Diff | 0.0 | 0.0 | 0.0 | Melanoma* (met) | 0.0 | 0.0 | 0.0 |

TABLE 57-continued

Panel 1.3D

| Tissue Name | Rel. Exp. (%) Ag2262, Run 150719071 | Rel. Exp. (%) Ag2262, Run 167966858 | Rel. Exp. (%) Ag2316, Run 162185396 | Tissue Name | Rel. Exp. (%) Ag2262, Run 150719071 | Rel. Exp. (%) Ag2262, Run 167966858 | Rel. Exp. (%) Ag2316, Run 162185396 |
|---|---|---|---|---|---|---|---|
| (ODO3866) | | | | Hs688(B).T | | | |
| Colon ca. HCC-2998 | 0.0 | 0.0 | 0.0 | Melanoma UACC-62 | 0.0 | 0.0 | 0.0 |
| Gastric ca. (liver met) NCI-N87 | 0.0 | 14.7 | 0.0 | Melanoma M14 | 0.0 | 0.0 | 0.0 |
| Bladder | 0.0 | 6.5 | 16.2 | Melanoma LOX IMVI | 0.0 | 0.0 | 0.0 |
| Trachea | 5.0 | 0.0 | 6.0 | Melanoma* (met) SK-MEL-5 | 0.0 | 0.0 | 0.0 |
| Kidney | 14.9 | 7.9 | 31.0 | Adipose | 0.0 | 0.0 | 7.6 |

TABLE 58

Panel 2D

| Tissue Name | Rel. Exp. (%) Ag2262, Run 150943107 | Tissue Name | Rel. Exp. (%) Ag2262, Run 150943107 |
|---|---|---|---|
| Normal Colon | 14.2 | Kidney Margin 8120608 | 24.0 |
| CC Well to Mod Diff (ODO3866) | 14.2 | Kidney Cancer 8120613 | 0.0 |
| CC Margin (ODO3866) | 0.0 | Kidney Margin 8120614 | 46.3 |
| CC Gr.2 rectosigmoid (ODO3868) | 0.0 | Kidney Cancer 9010320 | 0.0 |
| CC Margin (ODO3868) | 0.0 | Kidney Margin 9010321 | 16.5 |
| CC Mod Diff (ODO3920) | 0.0 | Normal Uterus | 16.4 |
| CC Margin (ODO3920) | 0.8 | Uterine Cancer 064011 | 0.0 |
| CC Gr.2 ascend colon (ODO3921) | 0.0 | Normal Thyroid | 15.6 |
| CC Margin (ODO3921) | 0.9 | Thyroid Cancer | 0.0 |
| CC from Partial Hepatectomy (ODO4309) Mets | 0.0 | Thyroid Cancer A302152 | 6.8 |
| Liver Margin (ODO4309) | 1.1 | Thyroid Margin A302153 | 0.0 |
| Colon mets to lung (OD04451-01) | 7.3 | Normal Breast | 9.3 |
| Lung Margin (OD04451-02) | 0.0 | Breast Cancer | 0.0 |
| Normal Prostate 6546-1 | 18.6 | Breast Cancer (OD04590-01) | 4.8 |
| Prostate Cancer (OD04410) | 10.2 | Breast Cancer Mets (OD04590-03) | 8.5 |
| Prostate Margin (OD04410) | 0.0 | Breast Cancer Metastasis | 0.0 |
| Prostate Cancer (OD04720-01) | 0.0 | Breast Cancer | 7.2 |
| Prostate Margin (OD04720-02) | 9.8 | Breast Cancer | 0.0 |
| Normal Lung | 22.5 | Breast Cancer 9100266 | 0.7 |
| Lung Met to Muscle (ODO4286) | 6.1 | Breast Margin 9100265 | 0.0 |
| Muscle Margin (ODO4286) | 0.0 | Breast Cancer A209073 | 0.0 |
| Lung Malignant Cancer (OD03126) | 5.4 | Breast Margin A2090734 | 0.0 |
| Lung Margin (OD03126) | 0.0 | Normal Liver | 0.0 |
| Lung Cancer (OD04404) | 7.6 | Liver Cancer | 0.0 |
| Lung Margin (OD04404) | 3.8 | Liver Cancer 1025 | 5.6 |
| Lung Cancer (OD04565) | 0.0 | Liver Cancer 1026 | 2.4 |
| Lung Margin (OD04565) | 0.0 | Liver Cancer 6004-T | 0.0 |
| Lung Cancer (OD04237-01) | 0.0 | Liver Tissue 6004-N | 8.7 |
| Lung Margin (OD04237-02) | 6.9 | Liver Cancer 6005-T | 0.0 |
| Ocular Mel Met to Liver (ODO4310) | 1.1 | Liver Tissue 6005-N | 0.0 |

TABLE 58-continued

Panel 2D

| Tissue Name | Rel. Exp. (%) Ag2262, Run 150943107 | Tissue Name | Rel. Exp. (%) Ag2262, Run 150943107 |
|---|---|---|---|
| Liver Margin (ODO4310) | 28.5 | Normal Bladder | 0.0 |
| Melanoma Metastasis | 0.0 | Bladder Cancer | 0.0 |
| Lung Margin (OD04321) | 0.0 | Bladder Cancer | 18.3 |
| Normal Kidney | 100.0 | Bladder Cancer (OD04718-01) | 0.0 |
| Kidney Ca, Nuclear grade 2 (OD04338) | 15.2 | Bladder Normal Adjacent (OD04718-03) | 0.0 |
| Kidney Margin (OD04338) | 40.3 | Normal Ovary | 0.0 |
| Kidney Ca Nuclear grade 1/2 (OD04339) | 0.0 | Ovarian Cancer | 7.5 |
| Kidney Margin (OD04339) | 50.0 | Ovarian Cancer (OD04768-07) | 0.0 |
| Kidney Ca, Clear cell type (OD04340) | 0.0 | Ovary Margin (OD04768-08) | 0.0 |
| Kidney Margin (OD04340) | 31.2 | Normal Stomach | 13.8 |
| Kidney Ca, Nuclear grade 3 (OD04348) | 0.0 | Gastric Cancer 9060358 | 0.0 |
| Kidney Margin (OD04348) | 29.9 | Stomach Margin 9060359 | 0.0 |
| Kidney Cancer (OD04622-01) | 0.0 | Gastric Cancer 9060395 | 0.0 |
| Kidney Margin (OD04622-03) | 58.6 | Stomach Margin 9060394 | 0.0 |
| Kidney Cancer (OD04450-01) | 0.0 | Gastric Cancer 9060397 | 0.0 |
| Kidney Margin (OD04450-03) | 95.9 | Stomach Margin 9060396 | 0.0 |
| Kidney Cancer 8120607 | 0.0 | Gastric Cancer 064005 | 0.0 |

TABLE 59

Panel 4D

| Tissue Name | Rel. Exp. (%) Ag2262, Run 150981162 | Rel. Exp. (%) Ag2316, Run 164037437 | Tissue Name | Rel. Exp. (%) Ag2262, Run 150981162 | Rel. Exp. (%) Ag2316, Run 164037437 |
|---|---|---|---|---|---|
| Secondary Th1 act | 0.0 | 0.0 | HUVEC IL-1beta | 0.0 | 0.0 |
| Secondary Th2 act | 0.0 | 0.0 | HUVEC IFN gamma | 0.0 | 0.0 |
| Secondary Tr1 act | 0.0 | 0.0 | HUVEC TNF alpha + IFN gamma | 11.6 | 0.0 |
| Secondary Th1 rest | 0.0 | 0.0 | HUVEC TNF alpha + IL4 | 0.0 | 0.0 |
| Secondary Th2 rest | 0.0 | 0.0 | HUVEC IL-11 | 8.7 | 0.0 |
| Secondary Tr1 rest | 0.0 | 0.0 | Lung Microvascular EC none | 0.0 | 0.0 |
| Primary Th1 act | 0.0 | 0.0 | Lung Microvascular EC TNFalpha + IL-1beta | 0.0 | 0.0 |
| Primary Th2 act | 0.0 | 0.0 | Microvascular Dermal EC none | 0.0 | 0.0 |
| Primary Tr1 act | 1.8 | 0.0 | Microvasular Dermal EC TNFalpha + IL-1beta | 0.0 | 0.0 |
| Primary Th1 rest | 0.0 | 0.0 | Bronchial epithelium TNFalpha + IL1beta | 0.0 | 0.0 |
| Primary Th2 rest | 0.0 | 0.0 | Small airway epithelium none | 0.0 | 0.0 |
| Primary Tr1 rest | 0.0 | 0.0 | Small airway epithelium TNFalpha + IL-1beta | 0.0 | 0.0 |
| CD45RA CD4 lymphocyte act | 0.0 | 0.0 | Coronery artery SMC rest | 0.0 | 0.0 |

TABLE 59-continued

Panel 4D

| Tissue Name | Rel. Exp. (%) Ag2262, Run 150981162 | Rel. Exp. (%) Ag2316, Run 164037437 | Tissue Name | Rel. Exp. (%) Ag2262, Run 150981162 | Rel. Exp. (%) Ag2316, Run 164037437 |
|---|---|---|---|---|---|
| CD45RO CD4 lymphocyte act | 0.0 | 0.0 | Coronery artery SMC TNFalpha + IL-1beta | 0.0 | 0.0 |
| CD8 lymphocyte act | 0.0 | 0.0 | Astrocytes rest | 0.0 | 0.0 |
| Secondary CD8 lymphocyte rest | 0.0 | 0.0 | Astrocytes TNFalpha + IL-1beta | 0.0 | 0.0 |
| Secondary CD8 lymphocyte act | 0.0 | 0.0 | KU-812 (Basophil) rest | 0.0 | 25.3 |
| CD4 lymphocyte none | 0.0 | 0.0 | KU-812 (Basophil) PMA/ionomycin | 0.0 | 0.0 |
| 2ry Th1/Th2/Tr1_anti-CD95 CH11 | 0.0 | 0.0 | CCD1106 (Keratinocytes) none | 0.0 | 0.0 |
| LAK cells rest | 0.0 | 0.0 | CCD1106 (Keratinocytes) TNFalpha + IL-1beta | 0.0 | 0.0 |
| LAK cells IL-2 | 0.0 | 0.0 | Liver cirrhosis | 0.0 | 0.0 |
| LAK cells IL-2 + IL-12 | 0.0 | 0.0 | Lupus kidney | 0.0 | 21.9 |
| LAK cells IL-2 + IFN gamma | 17.3 | 0.0 | NCI-H292 none | 0.0 | 0.0 |
| LAK cells IL-2 + IL-18 | 0.0 | 0.0 | NCI-H292 IL-4 | 0.0 | 0.0 |
| LAK cells PMA/ionomycin | 0.0 | 0.0 | NCI-H292 IL-9 | 0.0 | 0.0 |
| NK Cells IL-2 rest | 0.0 | 0.0 | NCI-H292 IL-13 | 0.0 | 0.0 |
| Two Way MLR 3 day | 0.0 | 0.0 | NCI-H292 IFN gamma | 0.0 | 0.0 |
| Two Way MLR 5 day | 17.1 | 0.0 | HPAEC none | 0.0 | 0.0 |
| Two Way MLR 7 day | 0.0 | 0.0 | HPAEC TNF alpha + IL-1 beta | 1.3 | 0.0 |
| PBMC rest | 0.0 | 0.0 | Lung fibroblast none | 0.0 | 0.0 |
| PBMC PWM | 0.0 | 0.0 | Lung fibroblast TNF alpha + IL-1 beta | 0.0 | 0.0 |
| PBMC PHA-L | 0.0 | 0.0 | Lung fibroblast IL-4 | 0.0 | 0.0 |
| Ramos (B cell) none | 0.0 | 0.0 | Lung fibroblast IL-9 | 0.0 | 0.0 |
| Ramos (B cell) ionomycin | 0.0 | 0.0 | Lung fibroblast IL-13 | 0.0 | 0.0 |
| B lymphocytes PWM | 0.0 | 0.0 | Lung fibroblast IFN gamma | 0.0 | 0.0 |
| B lymphocytes CD40L and IL-4 | 0.0 | 0.0 | Dermal fibroblast CCD1070 rest | 0.0 | 0.0 |
| EOL-1 dbcAMP | 0.0 | 0.0 | Dermal fibroblast CCD1070 TNF alpha | 0.0 | 0.0 |
| EOL-1 dbcAMP PMA/ionomycin | 0.0 | 0.0 | Dermal fibroblast CCD1070 IL-1 beta | 0.0 | 0.0 |
| Dendritic cells none | 0.0 | 0.0 | Dermal fibroblast IFN gamma | 0.0 | 0.0 |
| Dendritic cells LPS | 2.9 | 0.0 | Dermal fibroblast IL-4 | 0.0 | 0.0 |
| Dendritic cells anti-CD40 | 0.0 | 0.0 | IBD Colitis 2 | 0.0 | 0.0 |
| Monocytes rest | 0.0 | 0.0 | IBD Crohn's | 0.0 | 0.0 |
| Monocytes LPS | 0.0 | 0.0 | Colon | 100.0 | 12.7 |
| Macrophages rest | 8.2 | 0.0 | Lung | 72.2 | 0.0 |
| Macrophages LPS | 0.0 | 0.0 | Thymus | 47.3 | 100.0 |
| HUVEC none | 0.0 | 0.0 | Kidney | 0.0 | 0.0 |
| HUVEC starved | 1.8 | 0.0 | | | |

CNS_neurodegeneration_v1.0 Summary: Ag2316 Data from this one run is not included due to a potential problem in one of the sample wells.

Panel 1.3D Summary: Ag2262/2316 The expression of this gene was assessed in 3 separate runs using two independent probe and primer sets with significant expression detected in spleen and fetal kidney in all runs. Thus, the expression of this gene could be used to distinguish spleen from other tissues in the panel. Moreover, the expression of this gene could also be used to distinguish fetal kidney tissue from adult kidney tissue.

Panel 2D Summary: Ag2262 The expression of this gene is highest in a sample derived from normal kidney tissue. Of note was the profound association of the expression of this gene with normal kidney tissue when compared to adjacent malignant tissue. Thus, the expression of this gene could be used to distinguish normal kidney tissue from malignant kidney tissue. Moreover, therapeutic modulation of the expression or function of this gene through the use of small molecule drugs, antibodies or protein therapeutics might be of benefit in the treatment of kidney cancer.

Panel 4D Summary: Ag2316 This transcript is expressed almost exclusively in the thymus (CT 33.2). Therefore, this transcript could be used for detection of thymic tissues.

Ag2262 Using a second set of primers, expression of the NOV7 gene is also found in colon and lung, in addition to its expression in the thymus. Thus, this putative Wnt-15 protein may also play an important role in the normal homeostasis of these tissues. Therefore, therapeutics designed with the protein encoded by this transcript could be important for maintaining or restoring normal function to these organs during inflammation.

NOV8

Expression of gene NOV8 was assessed using the primer-probe set Ag2261, described in Table 60. Results of the RTQ-PCR runs are shown in Tables 61, 62 and 63.

TABLE 60

Probe Name Ag2261

| Primers | Sequences | Length | Start Position | SEQ ID NO: |
|---|---|---|---|---|
| Forward | 5'-ggatgactcgcctagcttct-3' | 20 | 858 | 178 |
| Probe | TET-5'-gccgtaggtgccaccgtgagaag-3'-TAMRA | 23 | 911 | 179 |
| Reverse | 5'-agcagatgctctcgcagtt-3' | 19 | 934 | 180 |

TABLE 61

Panel 1.3D

| Tissue Name | Rel. Exp. (%) Ag2261, Run 150631675 | Rel. Exp. (%) Ag2261, Run 152887692 | Tissue Name | Rel. Exp. (%) Ag2261, Run 150631675 | Rel. Exp. (%) Ag2261, Run 152887692 |
|---|---|---|---|---|---|
| Liver adenocarcinoma | 22.4 | 19.6 | Kidney (fetal) | 2.1 | 0.0 |
| Pancreas | 3.9 | 2.5 | Renal ca. 786-0 | 0.0 | 0.0 |
| Pancreatic ca. CAPAN 2 | 5.3 | 3.5 | Renal ca. A498 | 10.2 | 5.3 |
| Adrenal gland | 2.1 | 0.6 | Renal ca. RXF 393 | 0.0 | 0.0 |
| Thyroid | 7.0 | 9.8 | Renal ca. ACHN | 0.0 | 2.2 |
| Salivary gland | 1.9 | 2.1 | Renal ca. UO-31 | 0.0 | 0.0 |
| Pituitary gland | 1.0 | 2.2 | Renal ca. TK-10 | 0.0 | 0.0 |
| Brain (fetal) | 6.8 | 4.9 | Liver | 0.0 | 0.0 |
| Brain (whole) | 4.8 | 3.0 | Liver (fetal) | 7.6 | 0.0 |
| Brain (amygdala) | 4.6 | 5.3 | Liver ca. (hepatoblast) HepG2 | 0.0 | 0.0 |
| Brain (cerebellum) | 1.6 | 1.6 | Lung | 14.3 | 15.8 |
| Brain (hippocampus) | 7.5 | 11.3 | Lung (fetal) | 15.1 | 15.4 |
| Brain (substantia nigra) | 1.2 | 2.6 | Lung ca. (small cell) LX-1 | 1.6 | 0.0 |
| Brain (thalamus) | 2.5 | 1.7 | Lung ca. (small cell) NCI-H69 | 29.5 | 19.1 |
| Cerebral Cortex | 0.0 | 0.0 | Lung ca. (s. cell var.) SHP-77 | 11.0 | 5.1 |
| Spinal cord | 1.7 | 2.1 | Lung ca. (large cell)NCI-H460 | 0.0 | 0.0 |
| glio/astro U87-MG | 0.0 | 0.0 | Lung ca. (non-sm. cell) A549 | 0.0 | 1.2 |
| glio/astro U-118-MG | 55.1 | 50.3 | Lung ca. (non-s. cell) NCI-H23 | 0.0 | 1.3 |
| astrocytoma SW1783 | 0.0 | 7.5 | Lung ca. (non-s. cell) HOP-62 | 0.0 | 1.7 |
| neuro*; met SK-N-AS | 0.0 | 0.0 | Lung ca. (non-s. cl) NCI-H522 | 8.0 | 8.3 |
| astrocytoma SF-539 | 1.9 | 4.7 | Lung ca. (squain.) SW 900 | 4.0 | 0.0 |

TABLE 61-continued

Panel 1.3D

| Tissue Name | Rel. Exp. (%) Ag2261, Run 150631675 | Rel. Exp. (%) Ag2261, Run 152887692 | Tissue Name | Rel. Exp. (%) Ag2261, Run 150631675 | Rel. Exp. (%) Ag2261, Run 152887692 |
|---|---|---|---|---|---|
| astrocytoma SNB-75 | 2.0 | 4.9 | Lung ca. (squam.) NCI-H596 | 15.8 | 10.2 |
| glioma SNB-19 | 6.7 | 2.4 | Mammary gland | 7.2 | 4.1 |
| glioma U251 | 2.1 | 4.5 | Breast ca.* (pl. ef) MCF-7 | 1.7 | 3.4 |
| glioma SF-295 | 10.0 | 0.6 | Breast ca.* (pl. ef) MDA-MB-231 | 23.2 | 19.6 |
| Heart (Fetal) | 11.1 | 9.9 | Breast ca.* (pl. ef) T47D | 4.3 | 5.8 |
| Heart | 4.9 | 6.0 | Breast ca. BT-549 | 0.0 | 4.2 |
| Skeletal muscle (Fetal) | 100.0 | 100.0 | Breast ca. MDA-N | 0.0 | 0.0 |
| Skeletal muscle | 5.5 | 8.4 | Ovary | 3.6 | 3.1 |
| Bone marrow | 0.0 | 0.0 | Ovarian ca. OVCAR-3 | 1.1 | 1.0 |
| Thymus | 10.0 | 3.9 | Ovarian ca. OVCAR-4 | 0.0 | 0.0 |
| Spleen | 3.8 | 4.2 | Ovarian ca. OVCAR-5 | 0.0 | 0.0 |
| Lymph node | 5.0 | 1.1 | Ovarian ca. OVCAR-8 | 1.3 | 4.3 |
| Colorectal | 3.4 | 5.4 | Ovarian ca. IGROV-1 | 0.0 | 0.0 |
| Stomach | 6.0 | 15.4 | Ovarian ca. (ascites) SK-OV-3 | 7.5 | 16.0 |
| Small intestine | 15.9 | 18.7 | Uterus | 17.8 | 15.1 |
| Colon ca. SW480 | 24.3 | 15.3 | Placenta | 4.6 | 8.2 |
| Colon ca.* SW620 (SW480 met) | 0.0 | 0.0 | Prostate | 3.6 | 5.3 |
| Colon ca. HT29 | 0.0 | 0.0 | Prostate ca.* (bone met) PC-3 | 1.7 | 1.5 |
| Colon ca. HCT-116 | 3.8 | 0.6 | Testis | 21.9 | 14.6 |
| Colon ca. CaCo-2 | 0.0 | 0.8 | Melanoma Hs688(A).T | 3.1 | 4.7 |
| CC Well to Mod Diff(ODO3866) | 2.3 | 0.0 | Melanoma* (met) Hs688(B).T | 0.4 | 1.3 |
| Colon ca. HCC-2998 | 0.0 | 0.0 | Melanoma UACC-62 | 0.0 | 0.0 |
| Gastric ca. (liver met) NCI-N87 | 16.7 | 14.9 | Melanoma M14 | 0.0 | 0.0 |
| Bladder | 1.6 | 3.2 | Melanoma LOX IMVI | 0.0 | 0.0 |
| Trachea | 24.3 | 33.7 | Melanoma* (met) SK-MEL-5 | 0.0 | 2.0 |
| Kidney | 0.0 | 0.0 | Adipose | 6.7 | 7.2 |

TABLE 62

Panel 2D

| Tissue Name | Rel. Exp. (%) Ag2261, Run 150811744 | Rel. Exp. (%) Ag2261, Run 152887693 | Tissue Name | Rel. Exp. (%) Ag2261, Run 150811744 | Rel. Exp. (%) Ag2261, Run 152887693 |
|---|---|---|---|---|---|
| Normal Colon | 19.1 | 19.8 | Kidney Margin 8120608 | 2.4 | 0.0 |
| CC Well to Mod Diff (ODO3866) | 0.0 | 5.8 | Kidney Cancer 8120613 | 14.6 | 7.3 |
| CC Margin (ODO3866) | 19.5 | 12.5 | Kidney Margin 8120614 | 4.8 | 1.5 |

TABLE 62-continued

Panel 2D

| Tissue Name | Rel. Exp. (%) Ag2261, Run 150811744 | Rel. Exp. (%) Ag2261, Run 152887693 | Tissue Name | Rel. Exp. (%) Ag2261, Run 150811744 | Rel. Exp. (%) Ag2261, Run 152887693 |
|---|---|---|---|---|---|
| CC Gr.2 rectosigmoid (ODO3868) | 3.8 | 1.4 | Kidney Cancer 9010320 | 0.0 | 0.0 |
| CC Margin (ODO3868) | 2.6 | 5.1 | Kidney Margin 9010321 | 0.0 | 0.0 |
| CC Mod Diff (ODO3920) | 6.0 | 2.9 | Normal Uterus | 9.7 | 2.8 |
| CC Margin (ODO3920) | 23.8 | 6.4 | Uterine Cancer 064011 | 85.9 | 41.5 |
| CC Gr.2 ascend colon (ODO3921) | 9.3 | 2.2 | Normal Thyroid | 15.2 | 7.3 |
| CC Margin (ODO3921) | 16.8 | 11.7 | Thyroid Cancer | 0.0 | 3.0 |
| CC from Partial Hepatectomy (ODO4309) Mets | 2.4 | 0.0 | Thyroid Cancer A302152 | 1.9 | 1.2 |
| Liver Margin (ODO4309) | 2.6 | 0.0 | Thyroid Margin A302153 | 2.6 | 2.8 |
| Colon mets to lung (OD04451-01) | 7.9 | 4.5 | Normal Breast | 16.2 | 2.7 |
| Lung Margin (OD04451-02) | 11.3 | 12.9 | Breast Cancer | 78.5 | 29.7 |
| Normal Prostate 6546-1 | 6.3 | 2.6 | Breast Cancer (OD04590-01) | 37.6 | 23.8 |
| Prostate Cancer (OD04410) | 17.8 | 7.3 | Breast Cancer Mets (OD04590-03) | 100.0 | 24.5 |
| Prostate Margin (OD04410) | 10.7 | 7.4 | Breast Cancer Metastasis | 94.0 | 45.4 |
| Prostate Cancer (OD04720-01) | 4.7 | 4.4 | Breast Cancer | 25.7 | 24.8 |
| Prostate Margin (OD04720-02) | 13.9 | 5.6 | Breast Cancer | 23.2 | 7.1 |
| Normal Lung | 36.6 | 14.3 | Breast Cancer 9100266 | 33.0 | 7.5 |
| Lung Met to Muscle (ODO4286) | 1.0 | 0.0 | Breast Margin 9100265 | 7.6 | 7.6 |
| Muscle Margin (ODO4286) | 31.0 | 38.2 | Breast Cancer A209073 | 13.9 | 0.9 |
| Lung Malignant Cancer (OD03126) | 81.8 | 100.0 | Breast Margin A2090734 | 2.5 | 0.0 |
| Lung Margin (OD03126) | 35.8 | 18.2 | Normal Liver | 0.0 | 0.0 |
| Lung Cancer (OD04404) | 57.0 | 39.5 | Liver Cancer | 0.0 | 0.0 |
| Lung Margin (OD04404) | 9.4 | 11.8 | Liver Cancer 1025 | 4.8 | 1.7 |
| Lung Cancer (OD04565) | 37.1 | 42.0 | Liver Cancer 1026 | 7.1 | 0.0 |
| Lung Margin (OD04565) | 22.7 | 9.3 | Liver Cancer 6004-T | 4.8 | 0.0 |
| Lung Cancer (OD04237-01) | 5.3 | 6.4 | Liver Tissue 6004-N | 4.4 | 1.8 |
| Lung Margin (OD04237-02) | 78.5 | 32.8 | Liver Cancer 6005-T | 0.0 | 6.0 |
| Ocular Mel Met to Liver (ODO4310) | 0.0 | 0.0 | Liver Tissue 6005-N | 0.0 | 1.8 |
| Liver Margin (ODO4310) | 2.4 | 0.0 | Normal Bladder | 2.4 | 3.0 |
| Melanoma Metastasis | 13.0 | 0.0 | Bladder Cancer | 8.5 | 4.9 |
| Lung Margin (OD04321) | 96.6 | 50.0 | Bladder Cancer | 17.0 | 11.8 |
| Normal Kidney | 0.0 | 0.0 | Bladder Cancer (OD04718-01) | 10.0 | 5.7 |
| Kidney Ca, Nuclear grade 2 (OD04338) | 0.0 | 0.0 | Bladder Normal Adjacent (OD04718-03) | 19.3 | 27.5 |
| Kidney Margin (OD04338) | 4.0 | 4.6 | Normal Ovary | 13.6 | 12.4 |

TABLE 62-continued

Panel 2D

| Tissue Name | Rel. Exp. (%) Ag2261, Run 150811744 | Rel. Exp. (%) Ag2261, Run 152887693 | Tissue Name | Rel. Exp. (%) Ag2261, Run 150811744 | Rel. Exp. (%) Ag2261, Run 152887693 |
|---|---|---|---|---|---|
| Kidney Ca Nuclear grade 1/2 (OD04339) | 0.0 | 3.3 | Ovarian Cancer (OD04768-07) | 37.9 | 2.1 |
| Kidney Margin (OD04339) | 18.7 | 0.0 | Ovarian Cancer (OD04768-07) | 18.4 | 3.7 |
| Kidney Ca, Clear cell type (OD04340) | 8.8 | 11.7 | Ovary Margin (OD04768-08) | 28.3 | 12.2 |
| Kidney Margin (OD04340) | 0.0 | 2.0 | Normal Stomach | 48.3 | 17.3 |
| Kidney Ca, Nuclear grade 3 (OD04348) | 3.5 | 4.0 | Gastric Cancer 9060358 | 0.0 | 0.0 |
| Kidney Margin (OD04348) | 2.0 | 1.7 | Stomach Margin 9060359 | 9.9 | 3.0 |
| Kidney Cancer (OD04622-01) | 9.3 | 0.0 | Gastric Cancer 9060395 | 20.7 | 10.4 |
| Kidney Margin (OD04622-03) | 0.0 | 6.3 | Stomach Margin 9060394 | 10.0 | 12.2 |
| Kidney Cancer (OD04450-01) | 0.0 | 0.0 | Gastric Cancer 9060397 | 8.7 | 1.5 |
| Kidney Margin (OD04450-03) | 0.0 | 0.0 | Stomach Margin 9060396 | 7.5 | 6.2 |
| Kidney Cancer 8120607 | 0.0 | 0.7 | Gastric Cancer 064005 | 10.7 | 4.8 |

TABLE 63

Panel 4D

| Tissue Name | Rel. Exp. (%) Ag2261, Run 152887762 | Tissue Name | Rel. Exp. (%) Ag2261, Run 152887762 |
|---|---|---|---|
| Secondary Th1 act | 0.0 | HUVEC IL-1beta | 0.0 |
| Secondary Th2 act | 0.0 | HUVEC IFN gamma | 3.7 |
| Secondary Tr1 act | 0.0 | HUVEC TNF alpha + IFN gamma | 0.0 |
| Secondary Th1 rest | 0.0 | HUVEC TNF alpha + IL4 | 4.3 |
| Secondary Th2 rest | 0.0 | HUVEC IL-11 | 4.0 |
| Secondary Tr1 rest | 0.0 | Lung Microvascular EC none | 7.2 |
| Primary Th1 act | 0.0 | Lung Microvascular EC TNFalpha + IL-1beta | 0.0 |
| Primary Th2 act | 0.0 | Microvascular Dermal EC none | 8.4 |
| Primary Tr1 act | 0.0 | Microvasular Dermal EC TNFalpha + IL-1beta | 0.0 |
| Primary Th1 rest | 0.0 | Bronchial epithelium TNFalpha + IL1beta | 0.0 |
| Primary Th2 rest | 0.0 | Small airway epithelium none | 5.9 |
| Primary Tr1 rest | 0.0 | Small airway epithelium TNFalpha + IL-1beta | 24.3 |
| CD45RA CD4 lymphocyte act | 0.0 | Coronery artery SMC rest | 0.0 |
| CD45RO CD4 lymphocyte act | 0.0 | Coronery artery SMC TNFalpha + IL-1beta | 0.0 |
| CD8 lymphocyte act | 0.0 | Astrocytes rest | 3.3 |
| Secondary CD8 lymphocyte rest | 0.0 | Astrocytes TNFalpha + IL-1beta | 0.0 |
| Secondary CD8 lymphocyte act | 1.6 | KU-812 (Basophil) rest | 0.0 |
| CD4 lymphocyte none | 0.0 | KU-812 (Basophil) PMA/ionomycin | 0.0 |
| 2ry Th1/Th2/Tr1_anti-CD95 CH11 | 0.0 | CCD1106 (Keratinocytes) none | 47.3 |

TABLE 63-continued

Panel 4D

| Tissue Name | Rel. Exp. (%) Ag2261, Run 152887762 | Tissue Name | Rel. Exp. (%) Ag2261, Run 152887762 |
|---|---|---|---|
| LAK cells rest | 3.5 | CCD1106 (Keratinocytes) TNFalpha + IL-1beta | 9.0 |
| LAK cells IL-2 | 0.0 | Liver cirrhosis | 32.8 |
| LAK cells IL-2 + IL-12 | 0.0 | Lupus kidney | 0.0 |
| LAK cells IL-2 + IFN gamma | 0.0 | NCI-H292 none | 3.8 |
| LAK cells IL-2 + IL-18 | 0.0 | NCI-H292 IL-4 | 8.0 |
| LAK cells PMA/ionomycin | 26.1 | NCI-H292 IL-9 | 0.0 |
| NK Cells IL-2 rest | 0.0 | NCI-H292 IL-13 | 13.8 |
| Two Way MLR 3 day | 0.0 | NCI-H292 IFN gamma | 16.2 |
| Two Way MLR 5 day | 0.0 | HPAEC none | 6.7 |
| Two Way MLR 7 day | 0.0 | HPAEC TNF alpha + IL-1 beta | 0.0 |
| PBMC rest | 0.0 | Lung fibroblast none | 7.6 |
| PBMC PWM | 0.0 | Lung fibroblast TNF alpha + IL-1 beta | 3.1 |
| PBMC PHA-L | 0.0 | Lung fibroblast IL-4 | 4.3 |
| Ramos (B cell) none | 0.0 | Lung fibroblast IL-9 | 12.7 |
| Ramos (B cell) ionomycin | 0.0 | Lung fibroblast IL-13 | 6.8 |
| B lymphocytes PWM | 0.0 | Lung fibroblast IFN gamma | 30.4 |
| B lymphocytes CD40L and IL-4 | 3.1 | Dermal fibroblast CCD1070 rest | 0.0 |
| EOL-1 dbcAMP | 0.0 | Dermal fibroblast CCD1070 TNF alpha | 5.2 |
| EOL-1 dbcAMP PMA/ionomycin | 3.5 | Dermal fibroblast CCD1070 IL-1 beta | 0.0 |
| Dendritic cells none | 0.0 | Dermal fibroblast IFN gamma | 28.5 |
| Dendritic cells LPS | 0.0 | Dermal fibroblast IL-4 | 42.9 |
| Dendritic cells anti-CD40 | 0.0 | IBD Colitis 2 | 2.2 |
| Monocytes rest | 0.0 | IBD Crohn's | 3.1 |
| Monocytes LPS | 0.0 | Colon | 100.0 |
| Macrophages rest | 0.0 | Lung | 36.3 |
| Macrophages LPS | 0.0 | Thymus | 0.0 |
| HUVEC none | 0.0 | Kidney | 4.0 |
| HUVEC starved | 17.4 | | |

Panel 1.3D Summary: Ag2261 The 88091010_EXT gene is expressed at moderate levels in a number of metabolic tissues, with highest overall expression seen in fetal skeletal muscle (CTs=30.4–31.8). The higher levels of expression in fetal skeletal muscle when compared to adult skeletal muscle suggest that the protein product encoded by the 88091010_EXT gene may be useful in treating muscular dystrophy, Lesch-Nyhan syndrome, myasthenia gravis and other conditions that result in weak or dystrophic muscle. This gene is also expressed in adipose, thyroid and heart. Since biologic cross-talk between adipose and thyroid is a component of some forms of obesity, this gene product may be a protein therapeutic for the treatment of metabolic disease, including obesity and Type 2 diabetes.

Panel 2D Summary: Ag2261 The expression of this gene was assessed in two independent runs on panel 2D. This gene is consistently expressed in samples of breast cancer, uterine cancer and lung cancer when compared to their respective normal adjacent tissue controls. Thus, the expression of this gene could be used to distinguish breast cancer, lung cancer or uterine cancer from their normal tissues. Moreover, therapeutic modulation of this gene, through the use of small molecule drugs, antibodies or protein therapeutics might be of use in the treatment of breast, lung or uterine cancer.

Panel 4D Summary: Ag2261: This transcript is expressed at a low, but significant level in colon (CT 33.5). Low levels of expression of this transcript are also found in the lung, keratinocytes and dermal fibroblast. Thus, this transcript could be used as a marker for thymic, lung and skin tissues. The putative Wnt-14 encoded by this transcript may play an important role in the normal homeostasis of these tissues. Therefore, therapeutics designed with the protein encoded for by this transcript could be important for maintaining or restoring normal function to these organs during inflammation.

NOV9

Expression of NOV9 was assessed using the primer-probe set Ag2303, described in Table 64. Results of the RTQ-PCR runs are shown in Tables 65 and 66.

TABLE 64

Probe Name Ag2303

| Primers | Sequences | Length | Start Position | SEQ ID NO: |
|---|---|---|---|---|
| Forward | 5'-CATTGAGAGCGATAAGTTCACA-3' | 22 | 510 | 181 |
| Probe | TET-5'-AGAATGTGGAGCTCAACATCCACCTG-3'-TAMRA | 26 | 548 | 182 |
| Reverse | 5'-GATGCACGCTGAAGTCATTC-3' | 20 | 579 | 183 |

TABLE 65

Panel 1.3D

| Tissue Name | Rel. Exp. (%) Ag2303, Run 167985232 | Tissue Name | Rel. Exp. (%) Ag2303, Run 167985232 |
|---|---|---|---|
| Liver adenocarcinoma | 19.1 | Kidney (fetal) | 25.5 |
| Pancreas | 5.1 | Renal ca. 786-0 | 7.4 |
| Pancreatic ca. CAPAN 2 | 20.0 | Renal ca. A498 | 6.8 |
| Adrenal gland | 2.7 | Renal ca. RXF 393 | 15.5 |
| Thyroid | 2.3 | Renal ca. ACHN | 3.9 |
| Salivary gland | 7.2 | Renal ca. UO-31 | 6.3 |
| Pituitary gland | 5.0 | Renal ca. TK-10 | 16.4 |
| Brain (fetal) | 31.9 | Liver | 6.1 |
| Brain (whole) | 58.2 | Liver (fetal) | 6.7 |
| Brain (amygdala) | 33.9 | Liver ca. (hepatoblast) HepG2 | 11.7 |
| Brain (cerebellum) | 55.5 | Lung | 14.7 |
| Brain (hippocampus) | 23.3 | Lung (fetal) | 11.0 |
| Brain (*substantia nigra*) | 15.3 | Lung ca. (small cell) LX-1 | 36.6 |
| Brain (thalamus) | 21.9 | Lung ca. (small cell) NCI-H69 | 15.0 |
| Cerebral Cortex | 80.1 | Lung ca. (s.cell var.) SHP-77 | 60.7 |
| Spinal cord | 8.4 | Lung ca. (large cell) NCI-H460 | 5.4 |
| glio/astro U87-MG | 12.0 | Lung ca. (non-sm. cell) A549 | 14.3 |
| glio/astro U-118-MG | 10.8 | Lung ca. (non-s. cell) NCI-H23 | 37.4 |
| astrocytoma SW1783 | 15.5 | Lung ca. (non-s. cell) HOP-62 | 14.5 |
| neuro*; met SK-N-AS | 7.0 | Lung ca. (non-s. cl) NCI-H522 | 15.6 |
| astrocytoma SF-539 | 9.9 | Lung ca. (squam.) SW 900 | 16.2 |
| astrocytoma SNB-75 | 15.9 | Lung ca. (squam.) NCI-H596 | 33.2 |
| glioma SNB-19 | 8.7 | Mammary gland | 17.6 |
| glioma U251 | 20.7 | Breast ca.* (pl.ef) MCF-7 | 17.1 |
| glioma SF-295 | 7.9 | Breast ca.* (pl.ef) MDA-MB-231 | 6.7 |
| Heart (Fetal) | 46.0 | Breast ca.* (pl. ef) T47D | 29.7 |
| Heart | 9.8 | Breast ca. BT-549 | 4.0 |
| Skeletal muscle (Fetal) | 30.6 | Breast ca. MDA-N | 10.4 |
| Skeletal muscle | 26.6 | Ovary | 7.9 |
| Bone marrow | 29.5 | Ovarian ca. OVCAR-3 | 13.3 |
| Thymus | 32.3 | Ovarian ca. OVCAR-4 | 14.3 |
| Spleen | 26.4 | Ovarian ca. OVCAR-5 | 62.4 |
| Lymph node | 26.2 | Ovarian ca. OVCAR-8 | 3.9 |
| Colorectal | 11.0 | Ovarian ca. IGROV-1 | 6.2 |
| Stomach | 7.9 | Ovarian ca. (ascites) SK-OV-3 | 47.0 |
| Small intestine | 5.6 | Uterus | 5.0 |
| Colon ca. SW480 | 15.6 | Placenta | 3.2 |
| Colon ca.* SW620 (SW480 met) | 100.0 | Prostate | 8.0 |
| Colon ca. HT29 | 19.5 | Prostate ca.* (bone met) PC-3 | 21.5 |
| Colon ca. HCT-116 | 16.6 | Testis | 5.0 |
| Colon ca. CaCo-2 | 21.9 | Melanoma Hs688(A).T | 4.3 |
| CC Well to Mod Diff (ODO3866) | 13.1 | Melanoma* (met) Hs688(B).T | 3.6 |
| Colon ca. HCC-2998 | 33.9 | Melanoma UACC-62 | 7.0 |
| Gastric ca. (liver met) NCI-N87 | 18.8 | Melanoma M14 | 5.0 |
| Bladder | 7.2 | Melanoma LOX IMVI | 13.3 |
| Trachea | 4.0 | Melanoma* (met) SK-MEL-5 | 7.8 |
| Kidney | 7.6 | Adipose | 13.8 |

TABLE 66

Panel 4D

| Tissue Name | Rel. Exp. (%) Ag2303, Run 151630338 | Tissue Name | Rel. Exp. (%) Ag2303, Run 151630338 |
|---|---|---|---|
| Secondary Th1 act | 69.7 | HUVEC IL-1beta | 2.8 |
| Secondary Th2 act | 51.4 | HUVEC IFN gamma | 15.7 |
| Secondary Tr1 act | 66.0 | HUVEC TNF alpha + IFN gamma | 7.2 |
| Secondary Th1 rest | 24.5 | HUVEC TNF alpha + IL4 | 7.2 |
| Secondary Th2 rest | 28.9 | HUVEC IL-11 | 5.9 |
| Secondary Tr1 rest | 29.1 | Lung Microvascular EC none | 6.8 |
| Primary Th1 act | 53.2 | Lung Microvascular EC TNFalpha + IL-1beta | 5.4 |
| Primary Th2 act | 44.4 | Microvascular Dermal EC none | 10.1 |
| Primary Tr1 act | 66.0 | Microsvasular Dermal EC TNFalpha + IL-1beta | 6.7 |
| Primary Th1 rest | 89.5 | Bronchial epithelium TNFalpha + IL1beta | 7.2 |
| Primary Th2 rest | 66.0 | Small airway epithelium none | 4.1 |
| Primary Tr1 rest | 46.7 | Small airway epithelium TNFalpha + IL-1beta | 20.4 |
| CD45RA CD4 lymphocyte act | 36.3 | Coronery artery SMC rest | 7.7 |
| CD45RO CD4 lymphocyte act | 55.5 | Coronery artery SMC TNFalpha + IL-1beta | 6.1 |
| CD8 lymphocyte act | 56.3 | Astrocytes rest | 4.4 |
| Secondary CD8 lymphocyte rest | 47.6 | Astrocytes TNFalpha + IL-1beta | 3.0 |
| Secondary CD8 lymphocyte act | 48.0 | KU-812 (Basophil) rest | 17.3 |
| CD4 lymphocyte none | 15.2 | KU-812 (Basophil) PMA/ionomycin | 31.2 |
| 2ry Th1/Th2/Tr1_anti-CD95 CH11 | 41.2 | CCD1106 (Keratinocytes) none | 11.8 |
| LAK cells rest | 34.4 | CCD1106 (Keratinocytes) TNFalpha + IL-1 beta | 9.9 |
| LAK cells IL-2 | 69.3 | Liver cirrhosis | 2.0 |
| LAK cells IL-2 + IL-12 | 55.9 | Lupus kidney | 2.1 |
| LAK cells IL-2 + IFN gamma | 63.3 | NCI-H292 none | 21.0 |
| LAK cells IL-2 + IL-18 | 57.0 | NCI-H292 IL-4 | 33.2 |
| LAK cells PMA/ionomycin | 9.6 | NCI-H292 IL-9 | 33.2 |
| NK Cells IL-2 rest | 47.6 | NCI-H292 IL-13 | 20.9 |
| Two Way MLR 3 day | 38.7 | NCI-H292 IFN gamma | 25.0 |
| Two Way MLR 5 day | 39.5 | HPAEC none | 8.2 |
| Two Way MLR 7 day | 42.0 | HPAEC TNF alpha + IL-1 beta | 8.6 |
| PBMC rest | 21.5 | Lung fibroblast none | 5.9 |
| PBMC PWM | 100.0 | Lung fibroblast TNF alpha + IL-1 beta | 6.4 |
| PBMC PHA-L | 73.7 | Lung fibroblast IL-4 | 12.2 |
| Ramos (B cell) none | 54.3 | Lung fibroblast IL-9 | 9.9 |
| Ramos (B cell) ionomycin | 78.5 | Lung fibroblast IL-13 | 9.6 |
| B lymphocytes PWM | 90.1 | Lung fibroblast IFN gamma | 11.6 |
| B lymphocytes CD40L and IL-4 | 53.6 | Dermal fibroblast CCD1070 rest | 12.5 |
| EOL-1 dbcAMP | 57.4 | Dermal fibroblast CCD1070 TNF alpha | 67.8 |
| EOL-1 dbcAMP PMA/ionomycin | 18.8 | Dermal fibroblast CCD1070 IL-1 beta | 9.7 |
| Dendritic cells none | 22.1 | Dermal fibroblast IFN gamma | 5.5 |
| Dendritic cells LPS | 15.9 | Dermal fibroblast IL-4 | 7.4 |
| Dendritic cells anti-CD40 | 22.2 | IBD Colitis 2 | 2.0 |
| Monocytes rest | 45.4 | IBD Crohn's | 1.4 |
| Monocytes LPS | 17.3 | Colon | 20.4 |
| Macrophages rest | 36.1 | Lung | 14.0 |
| Macrophages LPS | 18.0 | Thymus | 10.6 |
| HUVEC none | 13.7 | Kidney | 31.6 |
| HUVEC starved | 19.8 | | |

Panel 1.3D Summary: Ag2303

NOV9 is widely expressed across the panel, with highest expression in a colon cancer cell line SW620 (CT=26.4). Of note is the difference in expression between the related colon cancer cell lines SW620 and SW480. SW480 represents the primary lesion from a patient with colon cancer, while SW620 represents a metastasis from the same patient. The difference in expression of this gene between the SW620 and SW480 cell lines indicates that it could be used to distingush these cells, or others like them. Moreover, therapeutic modulation of NOV9, through the use of small molecule drugs, antibodies or protein therapeutics, may be effective in the treatment of metastatic colon cancer.

Among tissues with metabolic function, NOV9 is moderately expressed in the pancreas, adrenal, thyroid, pituitary, adipose, adult and fetal heart, and adult and fetal liver. This expression profile suggests that the NOV9 product may be an important small molecule target for the treatment of metabolic disease in any or all of these tissues, including obesity and diabetes.

NOV9, which encodes a beta-adrenergic receptor kinase, also shows high expression in all regions of the brain examined, especially in the cerebral cortex (CT=26.7) The beta adrenergic receptors have been shown to play a role in memory formation and in clinical depression. Since many current anti-depressants produce undesired side effects as a result of non-specific binding (to other receptors), this gene is therefore an excellent small molecule target for the treatment of clinical depression without side effects. Furthermore, the role of beta adrenergic receptors in memory consolidation suggests that the NOV9 gene product would also be useful as a small molecule target for the treatment of Alzheimer's disease, vascular dementia, or any memory loss disorder.

References:

1. Feighner J P. Mechanism of action of antidepressant medications. J Clin Psychiatry 1999;60 Suppl 4:4–11; discussion 12–3

The psychopharmacology of depression is a field that has evolved rapidly in just under 5 decades. Early antidepressant medications—tricyclic antidepressants (TCAs) and monoamine oxidase inhibitors (MAOIs)—were discovered through astute clinical observations. These first-generation medications were effective because they enhanced serotonergic or noradrenergic mechanisms or both. Unfortunately, the TCAs also blocked histaminic, cholinergic, and alpha1-adrenergic receptor sites, and this action brought about unwanted side effects such as weight gain, dry mouth, constipation, drowsiness, and dizziness. MAOIs can interact with tyramine to cause potentially lethal hypertension and present potentially dangerous interactions with a number of medications and over-the-counter drugs. The newest generation of antidepressants, including the single-receptor selective serotonin reuptake inhibitors (SSRIs) and multiple-receptor antidepressants venlafaxine, mirtazapine, bupropion, trazodone, and nefazodone, target one or more specific brain receptor sites without, in most cases, activating unwanted sites such as histamine and acetylcholine. This paper discusses the new antidepressants, particularly with regard to mechanism of action, and looks at future developments in the treatment of depression.

2. Ferry B, McGaugh J L. Role of amygdala norepinephrine in mediating stress hormone regulation of memory storage. Acta Pharmacol Sin 2000 June;21(6):481–93

There is extensive evidence indicating that the noradrenergic system of the amygdala, particularly the basolateral nucleus of the amygdala (BLA), is involved in memory consolidation. This article reviews the central hypothesis that stress hormones released during emotionally arousing experiences activate noradrenergic mechanisms in the BLA, resulting in enhanced memory for those events. Findings from experiments using rats have shown that the memory-modulatory effects of the adrenocortical stress hormones epinephrine and glucocorticoids involve activation of beta-adrenoceptors in the BLA. In addition, both behavioral and microdialysis studies have shown that the noradrenergic system of the BLA also mediates the influences of other neuromodulatory systems such as opioid peptidergic and GABAergic systems on memory storage. Other findings indicate that this stress hormone-induced activation of noradrenergic mechanisms in the BLA regulates memory storage in other brain regions.

Panel 4D Summary: Ag2303

NOV9, a beta-adrenergic receptor kinase homolog, is highly expressed (CTs 26–29) in a wide range of cells that play a significance role in the immune response. Highest expression of this gene is found in activated B and T cells. Therefore, inhibition of the function of the protein encoded by NOV9 with a small molecule drug may block the functions of B cells or T cells and could be beneficial in the treatment of patients suffering from autoimmune and inflammatory diseases such as asthma, allergies, inflammatory bowel disease, lupus erythematosus, or rheumatoid arthritis.

NOV10

Expression of NOV10 was assessed using the primer-probe set Ag2311, described in Table 67. Results of the RTQ-PCR runs are shown in Tables 68, 69, 70 and 71.

TABLE 67

Probe Name Ag2311

| Primers | Sequences | Length | Start Position | SEQ ID NO: |
|---|---|---|---|---|
| Forward | 5'-CTCTGGGGACTCCTAATTTCTG-3' | 22 | 2913 | 184 |
| Probe | TET-5'-CCCAGCCTAAAGCAGGGATCAGTCTT-3'-TAMRA | 26 | 2939 | 185 |
| Reverse | 5'-TCCAAGGATTTATTCCACAAGA-3' | 22 | 2966 | 186 |

TABLE 68

CNS_neurodegeneration_v1.0

| Tissue Name | Rel. Exp. (%) Ag2311, Run 208253895 | Tissue Name | Rel. Exp. (%) Ag2311, Run 208253895 |
|---|---|---|---|
| AD 1 Hippo | 33.4 | Control (Path) 3 Temporal Ctx | 13.4 |
| AD 2 Hippo | 46.3 | Control (Path) 4 Temporal Ctx | 44.8 |
| AD 3 Hippo | 12.9 | AD 1 Occipital Ctx | 36.1 |
| AD 4 Hippo | 15.4 | AD 2 Occipital Ctx (Missing) | 0.0 |

TABLE 68-continued

CNS_neurodegeneration_v1.0

| Tissue Name | Rel. Exp. (%) Ag2311, Run 208253895 | Tissue Name | Rel. Exp. (%) Ag2311, Run 208253895 |
|---|---|---|---|
| AD 5 Hippo | 87.7 | AD 3 Occipital Ctx | 10.5 |
| AD 6 Hippo | 41.2 | AD 4 Occipital Ctx | 23.2 |
| Control 2 Hippo | 34.4 | AD 5 Occipital Ctx | 40.1 |
| Control 4 Hippo | 29.7 | AD 5 Occipital Ctx | 28.3 |
| Control (Path) 3 Hippo | 13.0 | Control 1 Occipital Ctx | 8.8 |
| AD 1 Temporal Ctx | 39.2 | Control 2 Occipital Ctx | 57.4 |
| AD 2 Temporal Ctx | 46.7 | Control 3 Occipital Ctx | 32.3 |
| AD 3 Temporal Ctx | 12.2 | Control 4 Occipital Ctx | 13.6 |
| AD 4 Temporal Ctx | 42.9 | Control (Path) 1 Occipital Ctx | 67.4 |
| AD 5 Inf Temporal Ctx | 100.0 | Control (Path) 2 Occipital Ctx | 26.8 |
| AD 5 Sup Temporal Ctx | 57.8 | Control (Path) 3 Occipital Ctx | 12.5 |
| AD 6 Inf Temporal Ctx | 48.3 | Control (Path) 4 Occipital Ctx | 36.6 |
| AD 6 Sup Temporal Ctx | 42.6 | Control 1 Parietal Ctx | 14.1 |
| Control 1 Temporal Ctx | 15.7 | Control 2 Parietal Ctx | 71.7 |
| Control 2 Temporal Ctx | 37.4 | Control 3 Parietal Ctx | 29.1 |
| Control 3 Temporal Ctx | 25.5 | Control (Path) 1 Parietal Ctx | 39.5 |
| Control 3 Temporal Ctx | 23.5 | Control (Path) 2 Parietal Ctx | 31.2 |
| Control (Path) 1 Temporal Ctx | 59.5 | Control (Path) 3 Parietal Ctx | 11.6 |
| Control (Path) 2 Temporal Ctx | 35.8 | Control (Path) 4 Parietal Ctx | 58.2 |

TABLE 69

Panel 1.3D

| Tissue Name | Rel. Exp. (%) Ag2311, Run 165627680 | Tissue Name | Rel. Exp. (%) Ag2311, Run 165627680 |
|---|---|---|---|
| Liver adenocarcinoma | 1.7 | Kidney (fetal) | 6.7 |
| Pancreas | 10.5 | Renal ca. 786-0 | 1.3 |
| Pancreatic ca. CAPAN 2 | 5.4 | Renal ca. A498 | 6.5 |
| Adrenal gland | 22.2 | Renal ca. RXF 393 | 3.3 |
| Thyroid | 21.5 | Renal ca. ACHN | 0.9 |
| Salivary gland | 10.6 | Renal ca. UO-31 | 1.1 |
| Pituitary gland | 24.7 | Renal ca. TK-10 | 1.3 |
| Brain (fetal) | 15.0 | Liver | 7.5 |
| Brain (whole) | 23.7 | Liver (fetal) | 10.8 |
| Brain (amygdala) | 24.7 | Liver ca. (hepatoblast) HepG2 | 2.0 |
| Brain (cerebellum) | 24.5 | Lung | 27.5 |
| Brain (hippocampus) | 35.1 | Lung (fetal) | 7.5 |
| Brain (substantia nigra) | 100.0 | Lung ca. (small cell) LX-1 | 4.6 |
| Brain (thalamus) | 27.7 | Lung ca. (small cell) NCI-H69 | 0.0 |
| Cerebral Cortex | 9.9 | Lung ca. (s. cell var.) SHP-77 | 5.4 |
| Spinal cord | 32.5 | Lung ca. (large cell) NCI-H460 | 19.1 |
| glio/astro U87-MG | 4.2 | Lung ca. (non-sm. cell) A549 | 3.2 |
| glio/astro U-118-MG | 9.2 | Lung ca. (non-s. cell) NCI-H23 | 5.1 |
| astrocytoma SW1783 | 3.7 | Lung ca. (non-s. cell) HOP-62 | 3.5 |
| neuro*; met SK-N-AS | 12.2 | Lung ca. (non-s. cl) NCI-H522 | 1.4 |
| astrocytoma SF-539 | 4.1 | Lung ca. (squam.) SW 900 | 1.9 |
| astrocytoma SNB-75 | 3.7 | Lung ca. (squam.) NCI-H596 | 0.3 |
| glioma SNB-19 | 5.8 | Mammary gland | 18.0 |
| glioma U251 | 28.9 | Breast ca.* (pl. ef) MCF-7 | 6.1 |
| glioma SF-295 | 4.5 | Breast ca.* (pl. ef) MDA-MB-231 | 3.8 |
| Heart (Fetal) | 5.4 | Breast ca.* (pl. ef) T47D | 6.3 |
| Heart | 12.3 | Breast ca. BT-549 | 1.0 |
| Skeletal muscle (Fetal) | 4.6 | Breast ca. MDA-N | 2.1 |
| Skeletal muscle | 22.8 | Ovary | 2.0 |
| Bone marrow | 15.1 | Ovarian ca. OVCAR-3 | 4.3 |
| Thymus | 17.9 | Ovarian ca. OVCAR-4 | 1.8 |
| Spleen | 21.9 | Ovarian ca. OVCAR-5 | 9.8 |
| Lymph node | 27.7 | Ovarian ca. OVCAR-8 | 1.0 |
| Colorectal | 3.0 | Ovarian ca. IGROV-1 | 0.8 |
| Stomach | 12.9 | Ovarian ca. (ascites) SK-OV-3 | 2.8 |
| Small intestine | 66.4 | Uterus | 29.3 |
| Colon ca. SW480 | 2.4 | Placenta | 8.2 |

TABLE 69-continued

Panel 1.3D

| Tissue Name | Rel. Exp. (%) Ag2311, Run 165627680 | Tissue Name | Rel. Exp. (%) Ag2311, Run 165627680 |
|---|---|---|---|
| Colon ca.* SW620 (SW480 met) | 4.1 | Prostate | 28.7 |
| Colon ca. HT29 | 2.4 | Prostate ca.* (bone met) PC-3 | 1.7 |
| Colon ca. HCT-116 | 2.7 | Testis | 38.7 |
| Colon ca. CaCo-2 | 3.0 | Melanoma Hs688(A).T | 1.3 |
| CC Well to Mod Diff (ODO3866) | 5.8 | Melanoma* (met) Hs688(B).T | 2.0 |
| Colon ca. HCC-2998 | 3.5 | Melanoma UACC-62 | 2.9 |
| Gastric ca. (liver met) NCI-N87 | 13.8 | Melanoma M14 | 11.0 |
| Bladder | 4.5 | Melanoma LOX IMVI | 0.2 |
| Trachea | 13.1 | Melanoma* (met) SK-MEL-5 | 2.9 |
| Kidney | 14.7 | Adipose | 9.7 |

TABLE 70

Panel 2.2

| Tissue Name | Rel. Exp. (%) Ag2311, Run 174370590 | Tissue Name | Rel. Exp. (%) Ag2311, Run 174370590 |
|---|---|---|---|
| Normal Colon | 9.4 | Kidney Margin (OD04348) | 100.0 |
| Colon cancer (OD06064) | 1.2 | Kidney malignant cancer (OD06204B) | 9.3 |
| Colon Margin (OD06064) | 0.6 | Kidney normal adjacent tissue (OD06204E) | 17.6 |
| Colon cancer (OD06159) | 1.5 | Kidney Cancer (OD04450-01) | 41.2 |
| Colon Margin (OD06159) | 5.5 | Kidney Margin (OD04450-03) | 14.9 |
| Colon cancer (OD06297-04) | 1.1 | Kidney Cancer 8120613 | 2.9 |
| Colon Margin (OD06297-015) | 9.6 | Kidney Margin 8120614 | 9.8 |
| CC Gr.2 ascend colon (ODO3921) | 9.8 | Kidney Cancer 9010320 | 6.7 |
| CC Margin (ODO3921) | 3.6 | Kidney Margin 9010321 | 5.4 |
| Colon cancer metastasis (OD06104) | 5.5 | Kidney Cancer 8120607 | 6.3 |
| Lung Margin (OD06104) | 1.2 | Kidney Margin 8120608 | 6.3 |
| Colon mets to lung (OD04451-01) | 22.2 | Normal Uterus | 17.6 |
| Lung Margin (OD04451-02) | 12.0 | Uterine Cancer 064011 | 11.2 |
| Normal Prostate | 6.2 | Normal Thyroid | 3.3 |
| Prostate Cancer (OD04410) | 4.3 | Thyroid Cancer | 11.1 |
| Prostate Margin (OD04410) | 9.6 | Thyroid Cancer A302152 | 33.4 |
| Normal Ovary | 17.3 | Thyroid Margin A302153 | 9.7 |
| Ovarian cancer (OD06283-03) | 6.7 | Normal Breast | 28.7 |
| Ovarian Margin (OD06283-07) | 8.8 | Breast Cancer | 9.7 |
| Ovarian Cancer | 10.7 | Breast Cancer | 14.9 |
| Ovarian cancer (OD06145) | 4.2 | Breast Cancer (OD04590-01) | 32.5 |
| Ovarian Margin (OD06145) | 29.5 | Breast Cancer Mets (OD04590-03) | 12.2 |
| Ovarian cancer (OD06455-03) | 7.9 | Breast Cancer Metastasis | 25.5 |
| Ovarian Margin (OD06455-07) | 2.4 | Breast Cancer | 15.9 |
| Normal Lung | 26.2 | Breast Cancer 9100266 | 1.8 |
| Invasive poor diff. lung adeno (ODO4945-01) | 8.3 | Breast Margin 9100265 | 1.6 |
| Lung Margin (ODO4945-03) | 6.0 | Breast Cancer A209073 | 2.1 |
| Lung Malignant Cancer (OD03126) | 16.0 | Breast Margin A2090734 | 26.6 |
| Lung Margin (OD03126) | 5.5 | Breast cancer (OD06083) | 25.0 |
| Lung Cancer (OD05014A) | 7.0 | Breast cancer node metastasis (OD06083) | 27.5 |
| Lung Margin (OD05014B) | 7.3 | Normal Liver | 23.7 |
| Lung cancer (OD06081) | 20.4 | Liver Cancer 1026 | 2.7 |
| Lung Margin (OD06081) | 12.3 | Liver Cancer 1025 | 29.5 |
| Lung Cancer (OD04237-01) | 9.5 | Liver Cancer 6004-T | 24.0 |
| Lung Margin (OD04237-02) | 18.4 | Liver Tissue 6004-N | 23.2 |
| Ocular Mel Met to Liver (OD04310) | 14.1 | Liver Cancer 6005-T | 9.0 |
| Liver Margin (ODO4310) | 15.0 | Liver Tissue 6005-N | 51.1 |
| Melanoma Metastasis | 12.5 | Liver Cancer | 31.4 |
| Lung Margin (OD04321) | 4.4 | Normal Bladder | 13.5 |

TABLE 70-continued

Panel 2.2

| Tissue Name | Rel. Exp. (%) Ag2311, Run 174370590 | Tissue Name | Rel. Exp. (%) Ag2311, Run 174370590 |
|---|---|---|---|
| Normal Kidney | 20.4 | Bladder Cancer | 6.4 |
| Kidney Ca, Nuclear grade 2 (OD04338) | 63.3 | Bladder Cancer | 11.3 |
| Kidney Margin (OD04338) | 11.5 | Normal Stomach | 48.6 |
| Kidney Ca Nuclear grade 1/2 (OD04339) | 46.3 | Gastric Cancer 9060397 | 5.6 |
| Kidney Margin (OD04339) | 17.4 | Stomach Margin 9060396 | 4.0 |
| Kidney Ca, Clear cell type (OD04340) | 24.8 | Gastric Cancer 9060395 | 4.0 |
| Kidney Margin (OD04340) | 17.0 | Stomach Margin 9060394 | 9.1 |
| Kidney Ca, Nuclear grade 3 (OD04348) | 3.1 | Gastric Cancer 064005 | 7.9 |

TABLE 71

Panel 4D

| Tissue Name | Rel. Exp. (%) Ag2311, Run 158928074 | Tissue Name | Rel. Exp. (%) Ag2311, Run 158928074 |
|---|---|---|---|
| Secondary Th1 act | 29.3 | HUVEC IL-1beta | 6.1 |
| Secondary Th2 act | 33.2 | HUVEC IFN gamma | 37.6 |
| Secondary Tr1 act | 45.7 | HUVEC TNF alpha + IFN gamma | 36.3 |
| Secondary Th1 rest | 17.3 | HUVEC TNF alpha + IL4 | 34.9 |
| Secondary Th2 rest | 19.2 | HUVEC IL-11 | 17.8 |
| Secondary Tr1 rest | 27.7 | Lung Microvascular EC none | 30.4 |
| Primary Th1 act | 36.9 | Lung Microvascular EC TNFalpha + IL-1 beta | 43.8 |
| Primary Th2 act | 36.9 | Microvascular Dermal EC none | 39.5 |
| Primary Tr1 act | 45.7 | Microsvasular Dermal EC TNFalpha + IL-1 beta | 27.4 |
| Primary Th1 rest | 38.7 | Bronchial epithelium TNFalpha + IL1beta | 1.2 |
| Primary Th2 rest | 27.0 | Small airway epithelium none | 6.2 |
| Primary Tr1 rest | 37.6 | Small airway epithelium TNFalpha + IL-1 beta | 20.0 |
| CD45RA CD4 lymphocyte act | 17.2 | Coronery artery SMC rest | 9.5 |
| CD45RO CD4 lymphocyte act | 24.0 | Coronery artery SMC TNFalpha + IL-1beta | 7.7 |
| CD8 lymphocyte act | 21.9 | Astrocytes rest | 10.9 |
| Secondary CD8 lymphocyte rest | 26.2 | Astrocytes TNFalpha + IL-1beta | 9.9 |
| Secondary CD8 lymphocyte act | 17.4 | KU-812 (Basophil) rest | 40.1 |
| CD4 lymphocyte none | 5.9 | KU-812 (Basophil) PMA/ionomycin | 52.9 |
| 2ry Th1/Th2/Tr1_anti-CD95 CH11 | 19.8 | CCD1106 (Keratinocytes) none | 9.6 |
| LAK cells rest | 32.8 | CCD1106 (Keratinocytes) TNFalpha + IL-1 beta | 0.6 |
| LAK cells IL-2 | 23.3 | Liver cirrhosis | 10.8 |
| LAK cells IL-2 + IL-12 | 31.0 | Lupus kidney | 6.9 |
| LAK cells IL-2 + IFN gamma | 27.5 | NCI-H292 none | 65.1 |
| LAK cells IL-2 + IL-18 | 38.7 | NCI-H292 IL-4 | 65.1 |
| LAK cells PMA/ionomycin | 17.4 | NCI-H292 IL-9 | 71.7 |
| NK Cells IL-2 rest | 28.5 | NCI-H292 IL-13 | 41.2 |
| Two Way MLR 3 day | 36.9 | NCI-H292 IFN gamma | 43.8 |
| Two Way MLR 5 day | 19.5 | HPAEC none | 30.8 |
| Two Way MLR 7 day | 16.4 | HPAEC TNF alpha + IL-1 beta | 16.8 |
| PBMC rest | 23.5 | Lung fibroblast none | 25.7 |
| PBMC PWM | 35.1 | Lung fibroblast TNF alpha + IL-1 beta | 9.0 |
| PBMC PHA-L | 17.8 | Lung fibroblast IL-4 | 43.5 |
| Ramos (B cell) none | 21.8 | Lung fibroblast IL-9 | 27.4 |
| Ramos (B cell) ionomycin | 37.4 | Lung fibroblast IL-13 | 29.1 |
| B lymphocytes PWM | 72.7 | Lung fibroblast IFN gamma | 23.5 |

TABLE 71-continued

Panel 4D

| Tissue Name | Rel. Exp. (%) Ag2311, Run 158928074 | Tissue Name | Rel. Exp. (%) Ag2311, Run 158928074 |
|---|---|---|---|
| B lymphocytes CD40L and IL-4 | 66.0 | Dermal fibroblast CCD1070 rest | 42.3 |
| EOL-1 dbcAMP | 35.8 | Dermal fibroblast CCD1070 TNF alpha | 62.9 |
| EOL-1 dbcAMP PMA/ionomycin | 38.4 | Dermal fibroblast CCD1070 IL-1 beta | 28.3 |
| Dendritic cells none | 59.0 | Dermal fibroblast IFN gamma | 18.3 |
| Dendritic cells LPS | 32.5 | Dermal fibroblast IL-4 | 33.2 |
| Dendritic cells anti-CD40 | 33.4 | IBD Colitis 2 | 5.3 |
| Monocytes rest | 42.9 | IBD Crohn's | 5.2 |
| Monocytes LPS | 25.0 | Colon | 27.5 |
| Macrophages rest | 42.3 | Lung | 14.5 |
| Macrophages LPS | 18.7 | Thymus | 47.6 |
| HUVEC none | 37.9 | Kidney | 100.0 |
| HUVEC starved | 40.1 | | |

CNS_neurodegeneration_v1.0 Summary: Ag2311

NOV10 does not show differential expression between Alzheimer's diseased brains and control brains. However, this panel confirms the expression of this gene in the brains of an independent group of patients. Please see panel 1.3d for discussion of utility in the central nervous system.

Panel 1.3D Summary: Ag2311

NOV10, an alpha mannosidase isoform, is expressed at moderate levels in all regions of the brain examined, with highest expression in the substantia nigra (CT=29.3). In the brain, alpha mannosidase has been implicated in the processes of myelination and axon growth. Therefore, therapeutic modulation of this gene or its protein product may be of use in the treatment of disorders where myelination has been compromised such as multiple sclerosis, and schizophrenia. In addition, the protein encoded by NOV10 could be useful in clinical situations where increased axonal growth is desired including spinal cord or brain trauma, stroke, or peripheral nerve injury.

NOV10 gene is moderately expressed (CT values=31–34) in a variety of metabolic tissues including pancreas, adrenal, thyroid, pituitary, adult and fetal heart, adult and fetal liver, adult and fetal skeletal muscle, and adipose. This expression profile suggests that the protein encoded by the NOV10 may be an important small molecule target for the treatment of metabolic disease in any or all of these tissues, including obesity and diabetes.

The expression of this gene appears to be generally associated with normal tissues when compared to cell lines. Of note was the difference in expression in normal prostate when compared to the prostate cancer cell line (PC-3). Thus, NOV10 could be used to distinguish this sample on the panel from other samples or to distinguish normal prostate from prostate cancer. Moreover, therapeutic modulation of this gene, through the use of small molecule drugs, antibodies or protein therapeutics, might be of use in the treatment of prostate cancer.

References:

1. Vite C H, McGowan J C, Braund K G, Drobatz K J, Glickson J D, Wolfe J H, Haskins M E. Histopathology, electrodiagnostic testing, and magnetic resonance imaging show significant peripheral and central nervous system myelin abnormalities in the cat model of alpha-mannosidosis. J Neuropathol Exp Neurol 2001 August;60 (8):817–28

Alpha-mannosidosis is a disease caused by the deficient activity of alpha-mannosidase, a lysosomal hydrolase involved in the degradation of glycoproteins. The disease is characterized by the accumulation of mannose-rich oligosaccharides within lysosomes. The purpose of this study was to characterize the peripheral nervous system (PNS) and central nervous system (CNS) myelin abnormalities in cats from a breeding colony with a uniform mutation in the gene encoding alpha-mannosidase. Three affected cats and 3 normal cats from 2 litters were examined weekly from 4 to 18 wk of age. Progressively worsening neurological signs developed in affected cats that included tremors, loss of balance, and nystagmus. In the PNS, affected cats showed slow motor nerve conduction velocity and increased F-wave latency. Single nerve fiber teasing revealed significant demyelination/remyelination in affected cats. Mean G-ratios of nerves showed a significant increase in affected cats compared to normal cats. Magnetic resonance imaging of the CNS revealed diffuse white matter signal abnormalities throughout the brain of affected cats. Quantitative magnetization transfer imaging showed a 8%–16% decrease in the magnetization transfer ratio in brain white matter of affected cats compared to normal cats, consistent with myelin abnormalities. Histology confirmed myelin loss throughout the cerebrum and cerebellum. Thus, histology, electrodiagnostic testing, and magnetic resonance imaging identified significant myelination abnormalities in both the PNS and CNS that have not been described previously in alpha-mannosidosis.

2. Zmuda J F, Rivas R J. The Golgi apparatus and the centrosome are localized to the sites of newly emerging axons in cerebellar granule neurons in vitro. Cell Motil Cytoskeleton 1998;41(1):18–38

Cultured cerebellar granule neurons develop their characteristic axonal and dendritic morphologies in a series of discrete temporal steps highly similar to those observed in situ, initially extending a single process, followed by the extension of a second process from the opposite pole of the cell, both of which develop into axons to generate a bipolar morphology. A mature morphology is attained following the outgrowth of multiple, short dendrites [Powell et al., 1997: J. Neurobiol. 32:223–236]. To determine the relationship between the localization of the Golgi apparatus, the site of microtubule nucleation (the centrosome), and the sites of initial and secondary axonal extension, the intracellular positioning of the Golgi and centrosome was observed during the differentiation of postnatal mouse granule neurons in vitro. The Golgi was labeled using the fluorescent lipid analogue, C5-DMB-Ceramide, or by indirect immunofluorescence using antibodies against the Golgi resident protein, alpha-mannosidase II. At 1–2 days in vitro (DIV), the Golgi was positioned at the base of the initial process in 99% of unipolar cells observed. By 3 DIV, many cells began the transition to a bipolar morphology by extending a short neurite from the pole of the cell opposite to the initial process. The Golgi was observed at this site of secondary outgrowth in 92% of these "transitional" cells, suggesting that the Golgi was repositioned from the base of the initial process to the site of secondary neurite outgrowth. As the second process elongated and the cells proceeded to the bipolar stage of development, or at later stages when distinct axonal and somatodendritic domains had been established, the Golgi was not consistently positioned at the base of either axons or dendrites, and was most often found at sites on the plasma membrane from which no processes originated. To determine the location of the centrosome in relation to the Golgi during development, granule neurons were labeled with antibodies against gamma-tubulin and optically sectioned using confocal microscopy. The centrosome was consistently co-localized with the Golgi during all stages of differentiation, and also appeared to be repositioned to the base of the newly emerging axon during the transition from a unipolar to a bipolar morphology. These findings indicate that during the early stages of granule cell axonal outgrowth, the Golgi-centrosome is positioned at the base of the initial axon and is then repositioned to the base of the newly emerging secondary axon. Such an intracellular reorientation of these organelles may be important in maintaining the characteristic developmental pattern of granule neurons by establishing the polarized microtubule network and the directed flow of membranous vesicles required for initial axonal elaboration Panel 2.2 Summary: Ag2311

The expression of this gene is highest in a sample derived from normal kidney tissue adjacent to a kidney cancer. Furthermore, there appears to be substantial expression in normal stomach, normal liver adjacent to a cancer, normal breast adjacent to a cancer and normal ovary adjacent to a cancer. Thus, the expression of this gene could be used to distinguish these normal tissues from their malignant counterparts. Moreover, therapeutic modulation of this gene, through the use of small molecule durgs, antibodies or protein therapeutics might be of use in the treatment of kidney, liver, breast or ovarian cancer.

Panel 4D Summary: Ag2311

NOV10 is modestly expressed (CT values=30–33) in a wide variety of immune cell types and tissues. The highest expression of this gene is found in B cells stimulated with PWM and anti-CD40, where stimulation normally leads to the production of immunoglobulin (Ig) and Ig switching. High levels of expression of this transcript are also found in a pulmonary muco-epidermoid cell line (H292) treated with Th2 cytokines. These findings suggest that the NOV10 product may be important in the pathogenesis, and/or treatment of autoimmune diseases such as lupus erythematosus, rheumatoid arthritis, inflammatory bowel disease, allergies which are associated with hyper IgE production, and lung inflammatory diseases such as asthma and emphysema. In addition, the high expression of this gene in the kidney suggests that the protein encoded by this transcript may be involved in normal tissue/cellular functions particularly in the kidney.

NOV11a, NOV11b

Expression of NOV11a and NOV11b was assessed using the primer-probe set Ag3670, described in Table 72. Results of the RTQ-PCR runs are shown in Tables 73 and 74.

TABLE 72

Probe Name Ag3670

| Primers | Sequences | Length | Start Position | SEQ ID NO: |
|---|---|---|---|---|
| Forward | 5'-ACGAGGTCTTCATCAAGCTG-3' | 20 | 705 | 187 |
| Probe | TET-5'-CACCAACAAGTACAGCACCTTCTCCG-3'-TAMRA | 26 | 751 | 188 |
| Reverse | 5'-CAGTCGGGGTAGATGATGAA-3' | 20 | 779 | 189 |

TABLE 73

General_screening_panel_v1.4

| Tissue Name | Rel. Exp. (%) Ag3670, Run 216517130 | Rel. Exp. (%) Ag3670, Run 222735036 | Tissue Name | Rel. Exp. (%) Ag3670, Run 216517130 | Rel. Exp. (%) Ag3670, Run 222735036 |
|---|---|---|---|---|---|
| Adipose | 0.2 | 0.4 | Renal ca. TK-10 | 2.1 | 1.1 |
| Melanoma* Hs688(A).T | 0.0 | 0.0 | Bladder | 0.4 | 0.0 |
| Melanoma* Hs688(B).T | 0.0 | 0.0 | Gastric ca. (liver met.) NCI-N87 | 0.8 | 0.4 |
| Melanoma* M14 | 6.0 | 6.9 | Gastric ca. KATO III | 0.4 | 0.4 |
| Melanoma* LOXIMVI | 2.6 | 1.8 | Colon ca. SW-948 | 0.0 | 0.1 |
| Melanoma* SK-MEL-5 | 5.9 | 8.2 | Colon ca. SW480 | 2.6 | 3.5 |
| Squamous cell carcinoma SCC-4 | 0.2 | 0.0 | Colon ca.* (SW480 met) SW620 | 1.3 | 0.8 |

TABLE 73-continued

General_screening_panel_v1.4

| Tissue Name | Rel. Exp. (%) Ag3670, Run 216517130 | Rel. Exp. (%) Ag3670, Run 222735036 | Tissue Name | Rel. Exp. (%) Ag3670, Run 216517130 | Rel. Exp. (%) Ag3670, Run 222735036 |
|---|---|---|---|---|---|
| Testis Pool | 3.2 | 1.5 | Colon ca. HT29 | 0.1 | 0.0 |
| Prostate ca.* (bone met) PC-3 | 11.0 | 11.7 | Colon ca. HCT-116 | 27.0 | 25.9 |
| Prostate Pool | 0.0 | 0.1 | Colon ca. CaCo-2 | 11.7 | 13.3 |
| Placenta | 0.0 | 0.0 | Colon cancer tissue | 0.0 | 0.3 |
| Uterus Pool | 0.1 | 0.1 | Colon ca. SW1116 | 12.9 | 7.2 |
| Ovarian ca. OVCAR-3 | 2.3 | 1.2 | Colon ca. Colo-205 | 0.4 | 0.2 |
| Ovarian ca. SK-OV-3 | 1.9 | 3.2 | Colon ca. SW-48 | 0.0 | 0.3 |
| Ovarian ca. OVCAR-4 | 1.5 | 1.5 | Colon Pool | 0.0 | 0.4 |
| Ovarian ca. OVCAR-5 | 6.3 | 6.0 | Small Intestine Pool | 0.0 | 0.0 |
| Ovarian ca. IGROV-1 | 0.6 | 1.6 | Stomach Pool | 0.1 | 0.2 |
| Ovarian ca. OVCAR-8 | 6.9 | 7.9 | Bone Marrow Pool | 0.2 | 0.1 |
| Ovary | 0.0 | 0.0 | Fetal Heart | 0.0 | 0.0 |
| Breast ca. MCF-7 | 1.5 | 2.7 | Heart Pool | 0.0 | 0.0 |
| Breast ca. MDA-MB-231 | 0.8 | 0.6 | Lymph Node Pool | 0.2 | 0.2 |
| Breast ca. BT 549 | 6.8 | 11.6 | Fetal Skeletal Muscle | 0.0 | 0.0 |
| Breast ca. T47D | 21.8 | 16.8 | Skeletal Muscle Pool | 0.0 | 0.0 |
| Breast ca. MDA-N | 4.0 | 2.8 | Spleen Pool | 0.0 | 0.0 |
| Breast Pool | 0.0 | 0.0 | Thymus Pool | 0.3 | 0.1 |
| Trachea | 0.0 | 0.3 | CNS cancer (glio/astro) U87-MG | 0.5 | 1.2 |
| Lung | 0.0 | 0.0 | CNS cancer (glio/astro) U-118-MG | 3.2 | 3.2 |
| Fetal Lung | 0.0 | 0.0 | CNS cancer (neuro;met) SK-N-AS | 6.4 | 10.0 |
| Lung ca. NCI-N417 | 5.7 | 4.5 | CNS cancer (astro) SF-539 | 2.6 | 0.8 |
| Lung ca. LX-1 | 0.2 | 0.5 | CNS cancer (astro) SNB-75 | 0.9 | 1.6 |
| Lung ca. NCI-H146 | 0.5 | 0.8 | CNS cancer (glio) SNB-19 | 0.3 | 0.8 |
| Lung ca. SHP-77 | 0.6 | 2.7 | CNS cancer (glio) SF-295 | 4.9 | 4.4 |
| Lung ca. A549 | 6.8 | 6.6 | Brain (Amygdala) Pool | 0.0 | 0.3 |
| Lung ca. NCI-H526 | 1.6 | 2.5 | Brain (cerebellum) | 0.0 | 0.3 |
| Lung ca. NCI-H23 | 16.4 | 12.7 | Brain (fetal) | 2.0 | 2.7 |
| Lung ca. NCI-H460 | 0.3 | 0.0 | Brain (Hippocampus) Pool | 0.3 | 0.8 |
| Lung ca. HOP-62 | 0.6 | 0.8 | Cerebral Cortex Pool | 0.0 | 0.2 |
| Lung ca. NCI-H522 | 48.6 | 46.0 | Brain (Substantia nigra) Pool | 0.4 | 0.7 |
| Liver | 0.0 | 0.0 | Brain (Thalamus) Pool | 0.4 | 0.9 |
| Fetal Liver | 0.0 | 0.0 | Brain (whole) | 0.1 | 0.1 |
| Liver ca. HepG2 | 0.1 | 0.3 | Spinal Cord Pool | 0.2 | 0.3 |
| Kidney Pool | 0.1 | 0.0 | Adrenal Gland | 0.0 | 0.0 |
| Fetal Kidney | 1.0 | 1.9 | Pituitary gland Pool | 0.0 | 0.3 |
| Renal ca. 786-0 | 100.0 | 100.0 | Salivary Gland | 0.2 | 0.2 |
| Renal ca. A498 | 10.2 | 21.3 | Thyroid (female) | 1.2 | 0.3 |
| Renal ca. ACHN | 0.5 | 0.2 | Pancreatic ca. CAPAN2 | 0.9 | 0.2 |
| Renal ca. UO-31 | 1.5 | 1.8 | Pancreas Pool | 0.0 | 0.2 |

TABLE 74

Panel 4.1D

| Tissue Name | Rel. Exp. (%) Ag3670, Run 223785547 | Tissue Name | Rel. Exp. (%) Ag3670, Run 223785547 |
|---|---|---|---|
| Secondary Th1 act | 0.0 | HUVEC IL-1beta | 27.5 |
| Secondary Th2 act | 0.0 | HUVEC IFN gamma | 29.9 |
| Secondary Tr1 act | 0.0 | HUVEC TNF alpha + IFN gamma | 19.5 |

TABLE 74-continued

Panel 4.1D

| Tissue Name | Rel. Exp. (%) Ag3670, Run 223785547 | Tissue Name | Rel. Exp. (%) Ag3670, Run 223785547 |
|---|---|---|---|
| Secondary Th1 rest | 0.0 | HUVEC TNF alpha + IL4 | 0.0 |
| Secondary Th2 rest | 0.0 | HUVEC IL-11 | 0.0 |
| Secondary Tr1 rest | 0.0 | Lung Microvascular EC none | 0.0 |
| Primary Th1 act | 0.0 | Lung Microvascular EC TNFalpha + IL-1beta | 11.6 |
| Primary Th2 act | 0.0 | Microvascular Dermal EC none | 0.0 |
| Primary Tr1 act | 0.0 | Microsvasular Dermal EC TNFalpha + IL-1beta | 71.7 |
| Primary Th1 rest | 0.0 | Bronchial epithelium TNFalpha + IL1beta | 53.2 |
| Primary Th2 rest | 0.0 | Small airway epithelium none | 0.0 |
| Primary Tr1 rest | 0.0 | Small airway epithelium TNFalpha + IL-1beta | 0.0 |
| CD45RA CD4 lymphocyte act | 0.0 | Coronery artery SMC rest | 0.0 |
| CD45RO CD4 lymphocyte act | 0.0 | Coronery artery SMC TNFalpha + IL-1beta | 0.0 |
| CD8 lymphocyte act | 15.1 | Astrocytes rest | 0.0 |
| Secondary CD8 lymphocyte rest | 0.0 | Astrocytes TNFalpha + IL-1beta | 0.0 |
| Secondary CD8 lymphocyte act | 39.5 | KU-812 (Basophil) rest | 0.0 |
| CD4 lymphocyte none | 0.0 | KU-812 (Basophil) PMA/ionomycin | 0.0 |
| 2ry Th1/Th2/Tr1_anti-CD95 CH11 | 0.0 | CCD1106 (Keratinocytes) none | 0.0 |
| LAK cells rest | 0.0 | CCD1106 (Keratinocytes) TNFalpha + IL-1beta | 38.2 |
| LAK cells IL-2 | 0.0 | Liver cirrhosis | 0.0 |
| LAK cells IL-2 + IL-12 | 0.0 | NCI-H292 none | 0.0 |
| LAK cells IL-2 + IFN gamma | 0.0 | NCI-H292 IL-4 | 34.9 |
| LAK cells IL-2 + IL-18 | 0.0 | NCI-H292 IL-9 | 24.8 |
| LAK cells PMA/ionomycin | 0.0 | NCI-H292 IL-13 | 21.5 |
| NK Cells IL-2 rest | 0.0 | NCI-H292 IFN gamma | 33.9 |
| Two Way MLR 3 day | 0.0 | HPAEC none | 0.0 |
| Two Way MLR 5 day | 0.0 | HPAEC TNF alpha + IL-1 beta | 0.0 |
| Two Way MLR 7 day | 0.0 | Lung fibroblast none | 12.8 |
| PBMC rest | 0.0 | Lung fibroblast TNF alpha + IL-1 beta | 0.0 |
| PBMC PWM | 0.0 | Lung fibroblast IL-4 | 29.3 |
| PBMC PHA-L | 0.0 | Lung fibroblast IL-9 | 46.7 |
| Ramos (B cell) none | 0.0 | Lung fibroblast IL-13 | 0.0 |
| Ramos (B cell) ionomycin | 0.0 | Lung fibroblast IFN gamma | 0.0 |
| B lymphocytes PWM | 0.0 | Dermal fibroblast CCD1070 rest | 24.5 |
| B lymphocytes CD40L and IL-4 | 0.0 | Dermal fibroblast CCD1070 TNF alpha | 22.8 |
| EOL-1 dbcAMP | 100.0 | Dermal fibroblast CCD1070 IL-1 beta | 0.0 |
| EOL-1 dbcAMP PMA/ionomycin | 45.1 | Dermal fibroblast IFN gamma | 0.0 |
| Dendritic cells none | 0.0 | Dermal fibroblast IL-4 | 0.0 |
| Dendritic cells LPS | 0.0 | Dermal Fibroblasts rest | 0.0 |
| Dendritic cells anti-CD40 | 0.0 | Neutrophils TNFa + LPS | 0.0 |
| Monocytes rest | 0.0 | Neutrophils rest | 0.0 |
| Monocytes LPS | 0.0 | Colon | 0.0 |
| Macrophages rest | 0.0 | Lung | 0.0 |
| Macrophages LPS | 0.0 | Thymus | 0.0 |
| HUVEC none | 25.9 | Kidney | 59.5 |
| HUVEC starved | 0.0 | | |

General_screening_panel_v1.4 Summary: Ag3670

Two experiments with the same probe and primer sets show results that are in excellent agreement, with highest expression in a renal cancer cell line. In general, the expression of this gene appears to be largely associated with samples derived from cancer cell lines rather than normal tissues. Of note is the substantial expression associated with kidney cancer cell lines as well as in colon cancer and lung cancer cell lines. Thus, the expression of this gene could be used to distinguish these cell lines from other cell lines. Moreover, therapeutic modulation of this gene, through the use of small molecule drugs, antibodies or protein therapeutics might be of use in the treatment of kidney, colon or lung cancer.

This gene is a C1q-related factor variant, and is expressed in at least the fetal brain, hippocampus, substantia nigra and thalamus. Various members of the complement cascade have been implicated in neuroinflammation and the pathology of Alzheimer's disease. Recent case controlled studies also suggest that the use of anti-inflammatory agents decreases the risk of Alzheimer's disease. Therefore, this gene is an excellent drug target for the disruption of neuroinflammation and the treatment of Alzheimer's disease, Huntington's disease, and stroke.

References:

Lue L F, Rydel R, Brigham E F, Yang L B, Hampel H, Murphy G M Jr, Brachova L, Yan S D, Walker D G, Shen Y, Rogers J. Inflammatory repertoire of Alzheimer's disease and nondemented elderly microglia in vitro. Glia 2001 July;35(1):72–9

In this study complement activation and biosynthesis have been analysed in the brains of Huntington's disease (HD) (n=9) and normal (n=3) individuals. In HD striatum, neurons, myelin and astrocytes were strongly stained with antibodies to C1q, C4, C3, iC3b-neoepitope and C9-neoepitope. In contrast, no staining for complement components was found in the normal striatum. Marked astrogliosis and microgliosis were observed in all HD caudate and the internal capsule samples but not in normal brain. RT-PCR analysis and in-situ hybridisation were carried out to determine whether complement was synthesised locally by activated glial cells. By RT-PCR, we found that complement activators of the classical pathway C1q C chain, C1r, C4, C3, as well as the complement regulators, C1 inhibitor, clusterin, MCP, DAF, CD59, were all expressed constitutively and at much higher level in HD brains compared to normal brain. Complement anaphylatoxin receptor mRNAs (C5a receptor and C3a receptor) were strongly expressed in HD caudate. In general, we found that the level of complement mRNA in normal control brains was from 2 to 5 fold lower compared to HD striatum. Using in-situ hybridisation, we confirmed that C3 mRNA and C9 mRNA were expressed by reactive microglia in HD internal capsule. We propose that complement produced locally by reactive microglia is activated on the membranes of neurons, contributing to neuronal necrosis but also to proinflammatory activities. Complement opsonins (iC3b) and anaphylatoxins (C3a, C5a) may be involved in the recruitment and stimulation of glial cells and phagocytes bearing specific complement receptors.

Panel 4.1D Summary: Ag3670

The NOV11 transcript, which encodes a protein with homology to a C1q related factor, is expressed at a low level in eosinophils, microvascular dermal endothelial cells and bronchial epithelium. The inflammatory cytokines TNF-a and IL-1b appear to up-regulate expression of this transcript in the endothelial cells and bronchial epithelium. This suggests that expression of this transcript is regulated by inflammatory conditions such as those found in lung inflammatory disease including pneumonia and bronchitis as well as skin infection or wounds. Expression of this transcript is also up regulated in lung fibroblasts by the Th2 cytokines IL9 or IL4, conditions found in asthma and COPD. The expression of this transcript in eosinophils, cells that are frequently associated with asthma, ulcerative colitis or other Th2 mediated diseases strongly suggest that modulation of the expression of this transcript will be beneficial in the treatment of atopic lung and skin diseases. Since the C1q factor is usually involved in the activation of complement and innate immunity, modulation of the expression of this transcript could modulate excessive inflammatory processes leading to these diseases.

Panel 5D Summary: Expression is low/undetectable for all samples in this panel (CT>35). (Data not shown).

NOV12

Expression of NOV12 was assessed using the primer-probe sets Ag1586 and Ag2011, described in Tables 75 and 76. Results of the RTQ-PCR runs are shown in Tables 77, 78, 79 and 80.

TABLE 75

Probe Name Ag1586

| Primers | Sequences | Length | Start Position | SEQ ID NO: |
|---|---|---|---|---|
| Forward | 5'-ACCAGGATGAGTTTGTGTCATC-3' | 22 | 735 | 190 |
| Probe | TET-5'-CTCAAGATCCCTTCGGACACGCTGT-3'-TAMRA | 25 | 761 | 191 |
| Reverse | 5'-TGCGGAAGCTGTACACATAGTA-3' | 22 | 809 | 192 |

TABLE 76

Probe Name Ag2011

| Primers | Sequences | Length | Start Position | SEQ ID NO: |
|---|---|---|---|---|
| Forward | 5'-ACCAGGATGAGTTTGTGTCATC-3' | 22 | 735 | 193 |
| Probe | TET-5'-CTCAAGATCCCTTCGGACACGCTGT-3'-TAMRA | 25 | 761 | 194 |
| Reverse | 5'-TGCGGAAGCTGTACACATAGTA-3' | 22 | 809 | 195 |

TABLE 77

| Panel 1.3D | | | | | |
|---|---|---|---|---|---|
| Tissue Name | Rel. Exp. (%) Ag1586, Run 146473155 | Rel. Exp. (%) Ag2011, Run 147816085 | Tissue Name | Rel. Exp. (%) Ag1586, Run 146473155 | Rel. Exp. (%) Ag2011, Run 147816085 |
| Liver adenocarcinoma | 29.9 | 37.6 | Kidney (fetal) | 3.8 | 3.7 |
| Pancreas | 1.7 | 0.7 | Renal ca. 786-0 | 6.1 | 11.7 |
| Pancreatic ca. CAPAN 2 | 6.3 | 9.6 | Renal ca. A498 | 25.0 | 25.9 |
| Adrenal gland | 2.6 | 2.5 | Renal ca. RXF 393 | 4.5 | 5.0 |
| Thyroid | 2.5 | 1.8 | Renal ca. ACHN | 8.8 | 11.3 |
| Salivary gland | 1.9 | 2.2 | Renal ca. UO-31 | 15.0 | 15.0 |
| Pituitary gland | 0.9 | 1.5 | Renal ca. TK-10 | 4.4 | 4.6 |
| Brain (fetal) | 12.2 | 13.1 | Liver | 0.2 | 0.1 |
| Brain (whole) | 9.7 | 10.7 | Liver (fetal) | 0.7 | 0.8 |
| Brain (amygdala) | 9.5 | 9.9 | Liver ca. (hepatoblast) HepG2 | 16.8 | 12.8 |
| Brain (cerebellum) | 3.3 | 2.3 | Lung | 5.0 | 5.1 |
| Brain (hippocampus) | 24.7 | 21.0 | Lung (fetal) | 7.4 | 8.1 |
| Brain (substantia nigra) | 0.9 | 1.3 | Lung ca. (small cell) LX-1 | 16.8 | 12.1 |
| Brain (thalamus) | 4.7 | 3.7 | Lung ca. (small cell) NCI-H69 | 18.4 | 23.7 |
| Cerebral Cortex | 75.8 | 71.2 | Lung ca. (s. cell var.) SHP-77 | 8.5 | 7.2 |
| Spinal cord | 2.0 | 2.4 | Lung ca. (large cell) NCI-H460 | 10.7 | 10.1 |
| glio/astro U87-MG | 15.3 | 17.9 | Lung ca. (non-sm. cell) A549 | 3.2 | 4.1 |
| glio/astro U-118-MG | 38.2 | 41.2 | Lung ca. (non-s. cell) NCI-H23 | 23.2 | 24.7 |
| astrocytoma SW1783 | 8.3 | 10.4 | Lung ca. (non-s. cell) HOP-62 | 18.9 | 15.7 |
| neuro*; met SK-N-AS | 23.5 | 24.3 | Lung ca. (non-s. cl) NCI-H522 | 5.6 | 7.5 |
| astrocytoma SF-539 | 19.6 | 38.4 | Lung ca. (squam.) SW 900 | 13.0 | 13.1 |
| astrocytoma SNB-75 | 44.4 | 45.1 | Lung ca. (squam.) NCI-H596 | 6.5 | 5.7 |
| glioma SNB-19 | 26.2 | 12.2 | Mammary gland | 11.5 | 9.3 |
| glioma U251 | 16.4 | 16.2 | Breast ca.* (pl. ef) MCF-7 | 14.1 | 14.4 |
| glioma SF-295 | 26.4 | 36.9 | Breast ca.* (pl. ef) MDA-MB-231 | 82.9 | 87.1 |
| Heart (Fetal) | 80.7 | 95.3 | Breast ca.* (pl. ef) T47D | 6.1 | 4.6 |
| Heart | 2.8 | 1.9 | Breast ca. BT-549 | 13.6 | 11.2 |
| Skeletal muscle (Fetal) | 85.3 | 87.7 | Breast ca. MDA-N | 28.1 | 31.6 |
| Skeletal muscle | 2.1 | 2.4 | Ovary | 20.9 | 19.5 |
| Bone marrow | 0.6 | 0.3 | Ovarian ca. OVCAR-3 | 33.0 | 40.1 |
| Thymus | 2.6 | 2.3 | Ovarian ca. OVCAR-4 | 5.5 | 5.4 |
| Spleen | 2.9 | 2.6 | Ovarian ca. OVCAR-5 | 10.9 | 13.1 |
| Lymph node | 5.1 | 5.2 | Ovarian ca. OVCAR-8 | 17.4 | 18.3 |
| Colorectal | 5.2 | 3.9 | Ovarian ca. IGROV-1 | 4.5 | 5.3 |
| Stomach | 3.7 | 5.6 | Ovarian ca. (ascites) SK-OV-3 | 25.7 | 22.4 |
| Small intestine | 1.6 | 1.3 | Uterus | 2.7 | 2.4 |
| Colon ca. SW480 | 45.4 | 55.5 | Placenta | 6.7 | 10.2 |
| Colon ca.* SW620 (SW480 met) | 11.3 | 11.1 | Prostate | 0.4 | 1.4 |
| Colon ca. HT29 | 13.3 | 13.3 | Prostate ca.* (bone met) PC-3 | 8.4 | 11.3 |
| Colon ca. HCT-116 | 10.5 | 10.5 | Testis | 8.1 | 8.5 |
| Colon ca. CaCo-2 | 24.0 | 23.0 | Melanoma Hs688(A).T | 59.0 | 86.5 |
| CC Well to Mod Diff (ODO3866) | 19.1 | 16.6 | Melanoma* (met) Hs688(B).T | 100.0 | 100.0 |
| Colon ca. HCC-2998 | 25.7 | 20.3 | Melanoma UACC-62 | 17.6 | 19.5 |
| Gastric ca. (liver met) NCI-N87 | 59.9 | 62.9 | Melanoma M14 | 16.3 | 21.9 |
| Bladder | 1.8 | 4.6 | Melanoma LOX IMVI | 3.6 | 5.8 |

TABLE 77-continued

Panel 1.3D

| Tissue Name | Rel. Exp. (%) Ag1586, Run 146473155 | Rel. Exp. (%) Ag2011, Run 147816085 | Tissue Name | Rel. Exp. (%) Ag1586, Run 146473155 | Rel. Exp. (%) Ag2011, Run 147816085 |
|---|---|---|---|---|---|
| Trachea | 6.9 | 5.6 | Melanoma* (met) SK-MEL-5 | 12.9 | 22.1 |
| Kidney | 0.8 | 0.7 | Adipose | 5.6 | 4.5 |

TABLE 78

Panel 2.2

| Tissue Name | Rel. Exp. (%) Ag2011, Run 174154748 | Tissue Name | Rel. Exp. (%) Ag2011, Run 174154748 |
|---|---|---|---|
| Normal Colon | 24.7 | Kidney Margin (OD04348) | 68.3 |
| Colon cancer (OD06064) | 48.6 | Kidney malignant cancer (OD06204B) | 25.0 |
| Colon Margin (OD06064) | 4.9 | Kidney normal adjacent tissue (OD06204E) | 7.4 |
| Colon cancer (OD06159) | 9.3 | Kidney Cancer (OD04450-01) | 34.4 |
| Colon Margin (OD06159) | 19.5 | Kidney Margin (OD04450-03) | 18.4 |
| Colon cancer (OD06297-04) | 11.7 | Kidney Cancer 8120613 | 9.7 |
| Colon Margin (OD06297-015) | 12.5 | Kidney Margin 8120614 | 18.8 |
| CC Gr.2 ascend colon (ODO3921) | 17.3 | Kidney Cancer 9010320 | 16.2 |
| CC Margin (ODO3921) | 14.2 | Kidney Margin 9010321 | 13.8 |
| Colon cancer metastasis (OD06104) | 8.6 | Kidney Cancer 8120607 | 37.1 |
| Lung Margin (OD06104) | 8.3 | Kidney Margin 8120608 | 7.0 |
| Colon mets to lung (OD04451-01) | 23.0 | Normal Uterus | 21.9 |
| Lung Margin (OD04451-02) | 32.8 | Uterine Cancer 064011 | 13.7 |
| Normal Prostate | 4.8 | Normal Thyroid | 2.4 |
| Prostate Cancer (OD04410) | 4.9 | Thyroid Cancer | 8.1 |
| Prostate Margin (OD04410) | 8.8 | Thyroid Cancer A302152 | 35.4 |
| Normal Ovary | 32.3 | Thyroid Margin A302153 | 8.7 |
| Ovarian cancer (OD06283-03) | 32.1 | Normal Breast | 29.7 |
| Ovarian Margin (OD06283-07) | 13.8 | Breast Cancer | 11.9 |
| Ovarian Cancer | 19.9 | Breast Cancer | 47.6 |
| Ovarian cancer (OD06145) | 9.2 | Breast Cancer (OD04590-01) | 25.5 |
| Ovarian Margin (OD06145) | 8.6 | Breast Cancer Mets (OD04590-03) | 38.4 |
| Ovarian cancer (OD06455-03) | 13.0 | Breast Cancer Metastasis | 30.1 |
| Ovarian Margin (OD06455-07) | 2.1 | Breast Cancer | 41.5 |
| Normal Lung | 27.2 | Breast Cancer 9100266 | 9.2 |
| Invasive poor diff. lung adeno (ODO4945-01) | 28.5 | Breast Margin 9100265 | 18.2 |
| Lung Margin (ODO4945-03) | 15.0 | Breast Cancer A209073 | 14.9 |
| Lung Malignant Cancer (OD03126) | 30.4 | Breast Margin A2090734 | 37.6 |
| Lung Margin (OD03126) | 15.9 | Breast cancer (OD06083) | 55.9 |
| Lung Cancer (OD05014A) | 39.5 | Breast cancer node metastasis (OD06083) | 48.6 |
| Lung Margin (OD05014B) | 22.1 | Normal Liver | 10.4 |
| Lung cancer (OD06081) | 23.7 | Liver Cancer 1026 | 9.1 |
| Lung Margin (OD06081) | 16.8 | Liver Cancer 1025 | 20.7 |
| Lung Cancer (OD04237-01) | 9.0 | Liver Cancer 6004-T | 12.2 |
| Lung Margin (OD04237-02) | 41.5 | Liver Tissue 6004-N | 8.0 |
| Ocular Mel Met to Liver (ODO4310) | 100.0 | Liver Cancer 6005-T | 36.6 |
| Liver Margin (ODO4310) | 4.2 | Liver Tissue 6005-N | 25.0 |
| Melanoma Metastasis | 47.0 | Liver Cancer | 4.5 |
| Lung Margin (OD04321) | 28.1 | Normal Bladder | 18.7 |
| Normal Kidney | 12.3 | Bladder Cancer | 17.2 |
| Kidney Ca, Nuclear grade 2 (OD04338) | 18.3 | Bladder Cancer | 72.7 |
| Kidney Margin (OD04338) | 18.0 | Normal Stomach | 33.4 |
| Kidney Ca Nuclear grade 1/2 (OD04339) | 83.5 | Gastric Cancer 9060397 | 9.6 |
| Kidney Margin (OD04339) | 10.4 | Stomach Margin 9060396 | 10.4 |
| Kidney Ca, Clear cell type (OD04340) | 22.2 | Gastric Cancer 9060395 | 7.6 |

TABLE 78-continued

Panel 2.2

| Tissue Name | Rel. Exp. (%) Ag2011, Run 174154748 | Tissue Name | Rel. Exp. (%) Ag2011, Run 174154748 |
|---|---|---|---|
| Kidney Margin (OD04340) | 12.7 | Stomach Margin 9060394 | 19.6 |
| Kidney Ca, Nuclear grade 3 (OD04348) | 15.7 | Gastric Cancer 064005 | 17.4 |

TABLE 79

Panel 2D

| Tissue Name | Rel. Exp. (%) Ag1586, Run 162624476 | Tissue Name | Rel. Exp. (%) Ag1586, Run 162624476 |
|---|---|---|---|
| Normal Colon | 34.9 | Kidney Margin 8120608 | 14.2 |
| CC Well to Mod Diff (ODO3866) | 28.3 | Kidney Cancer 8120613 | 30.4 |
| CC Margin (ODO3866) | 9.2 | Kidney Margin 8120614 | 17.7 |
| CC Gr.2 rectosigmoid (ODO3868) | 25.9 | Kidney Cancer 9010320 | 57.0 |
| CC Margin (ODO3868) | 4.7 | Kidney Margin 9010321 | 40.9 |
| CC Mod Diff (ODO3920) | 55.5 | Normal Uterus | 10.4 |
| CC Margin (ODO3920) | 14.2 | Uterine Cancer 064011 | 28.9 |
| CC Gr.2 ascend colon (ODO3921) | 62.9 | Normal Thyroid | 8.4 |
| CC Margin (ODO3921) | 12.1 | Thyroid Cancer | 16.7 |
| CC from Partial Hepatectomy (ODO4309) Mets | 41.5 | Thyroid Cancer A302152 | 24.7 |
| Liver Margin (ODO4309) | 13.6 | Thyroid Margin A302153 | 17.7 |
| Colon mets to lung (OD04451-01) | 18.0 | Normal Breast | 60.3 |
| Lung Margin (OD04451-02) | 25.5 | Breast Cancer | 24.1 |
| Normal Prostate 6546-1 | 17.0 | Breast Cancer (OD04590-01) | 47.0 |
| Prostate Cancer (OD04410) | 33.7 | Breast Cancer Mets (OD04590-03) | 72.7 |
| Prostate Margin (OD04410) | 28.9 | Breast Cancer Metastasis | 37.4 |
| Prostate Cancer (OD04720-01) | 33.7 | Breast Cancer | 36.9 |
| Prostate Margin (OD04720-02) | 45.7 | Breast Cancer | 65.1 |
| Normal Lung | 80.7 | Breast Cancer 9100266 | 39.8 |
| Lung Met to Muscle (ODO4286) | 100.0 | Breast Margin 9100265 | 31.2 |
| Muscle Margin (ODO4286) | 21.5 | Breast Cancer A209073 | 49.0 |
| Lung Malignant Cancer (OD03126) | 57.8 | Breast Margin A2090734 | 44.8 |
| Lung Margin (OD03126) | 61.6 | Normal Liver | 4.5 |
| Lung Cancer (OD04404) | 70.2 | Liver Cancer | 2.6 |
| Lung Margin (OD04404) | 34.2 | Liver Cancer 1025 | 4.7 |
| Lung Cancer (OD04565) | 87.7 | Liver Cancer 1026 | 18.3 |
| Lung Margin (OD04565) | 23.8 | Liver Cancer 6004-T | 7.6 |
| Lung Cancer (OD04237-01) | 41.5 | Liver Tissue 6004-N | 12.0 |
| Lung Margin (OD04237-02) | 34.2 | Liver Cancer 6005-T | 12.1 |
| Ocular Mel Met to Liver (ODO4310) | 97.3 | Liver Tissue 6005-N | 5.7 |
| Liver Margin (ODO4310) | 5.0 | Normal Bladder | 38.2 |
| Melanoma Metastasis | 87.7 | Bladder Cancer | 21.3 |
| Lung Margin (OD04321) | 56.3 | Bladder Cancer | 46.0 |
| Normal Kidney | 30.1 | Bladder Cancer (OD04718-01) | 96.6 |
| Kidney Ca, Nuclear grade 2 (OD04338) | 46.7 | Bladder Normal Adjacent (OD04718-03) | 29.5 |
| Kidney Margin (OD04338) | 14.8 | Normal Ovary | 21.5 |
| Kidney Ca Nuclear grade 1/2 (OD04339) | 52.1 | Ovarian Cancer | 73.7 |
| Kidney Margin (OD04339) | 20.3 | Ovarian Cancer (OD04768-07) | 48.3 |
| Kidney Ca, Clear cell type (OD04340) | 49.0 | Ovary Margin (OD04768-08) | 18.8 |
| Kidney Margin (OD04340) | 23.2 | Normal Stomach | 13.9 |
| Kidney Ca, Nuclear grade 3 (OD04348) | 42.6 | Gastric Cancer 9060358 | 6.7 |
| Kidney Margin (OD04348) | 28.9 | Stomach Margin 9060359 | 13.2 |
| Kidney Cancer (OD04622-01) | 50.7 | Gastric Cancer 9060395 | 28.3 |
| Kidney Margin (OD04622-03) | 8.6 | Stomach Margin 9060394 | 18.0 |
| Kidney Cancer (OD04450-01) | 21.8 | Gastric Cancer 9060397 | 45.4 |

TABLE 79-continued

Panel 2D

| Tissue Name | Rel. Exp. (%) Ag1586, Run 162624476 | Tissue Name | Rel. Exp. (%) Ag1586, Run 162624476 |
|---|---|---|---|
| Kidney Margin (OD04450-03) | 18.2 | Stomach Margin 9060396 | 10.4 |
| Kidney Cancer 8120607 | 25.0 | Gastric Cancer 064005 | 48.3 |

TABLE 80

Panel 4D

| Tissue Name | Rel. Exp. (%) Ag2011, Run 160997385 | Tissue Name | Rel. Exp. (%) Ag2011, Run 160997385 |
|---|---|---|---|
| Secondary Th1 act | 4.7 | HUVEC IL-1beta | 2.0 |
| Secondary Th2 act | 6.4 | HUVEC IFN gamma | 4.0 |
| Secondary Tr1 act | 8.6 | HUVEC TNF alpha + IFN gamma | 5.0 |
| Secondary Th1 rest | 0.6 | HUVEC TNF alpha + IL4 | 8.4 |
| Secondary Th2 rest | 1.7 | HUVEC IL-11 | 3.5 |
| Secondary Tr1 rest | 1.7 | Lung Microvascular EC none | 13.0 |
| Primary Th1 act | 14.0 | Lung Microvascular EC TNFalpha + IL-1beta | 15.3 |
| Primary Th2 act | 7.7 | Microvascular Dermal EC none | 23.2 |
| Primary Tr1 act | 12.9 | Microvasular Dermal EC TNFalpha + IL-1beta | 17.3 |
| Primary Th1 rest | 3.3 | Bronchial epithelium TNFalpha + IL1beta | 4.5 |
| Primary Th2 rest | 2.3 | Small airway epithelium none | 16.0 |
| Primary Tr1 rest | 2.0 | Small airway epithelium TNFalpha + IL-1beta | 100.0 |
| CD45RA CD4 lymphocyte act | 6.5 | Coronery artery SMC rest | 15.7 |
| CD45RO CD4 lymphocyte act | 5.3 | Coronery artery SMC TNFalpha + IL-1beta | 11.1 |
| CD8 lymphocyte act | 3.3 | Astrocytes rest | 25.3 |
| Secondary CD8 lymphocyte rest | 7.2 | Astrocytes TNFalpha + IL-1beta | 21.6 |
| Secondary CD8 lymphocyte act | 3.0 | KU-812 (Basophil) rest | 8.4 |
| CD4 lymphocyte none | 1.6 | KU-812 (Basophil) PMA/ionomycin | 39.5 |
| 2ry Th1/Th2/Tr1_anti-CD95 CH11 | 0.3 | CCD1106 (Keratinocytes) none | 35.1 |
| LAK cells rest | 19.1 | CCD1106 (Keratinocytes) TNFalpha + IL-1beta | 5.9 |
| LAK cells IL-2 | 3.1 | Liver cirrhosis | 0.9 |
| LAK cells IL-2 + IL-12 | 6.5 | Lupus kidney | 1.3 |
| LAK cells IL-2 + IFN gamma | 9.8 | NCI-H292 none | 42.3 |
| LAK cells IL-2 + IL-18 | 5.9 | NCI-H292 IL-4 | 90.1 |
| LAK cells PMA/ionomycin | 8.7 | NCI-H292 IL-9 | 58.2 |
| NK Cells IL-2 rest | 1.7 | NCI-H292 IL-13 | 33.9 |
| Two Way MLR 3 day | 9.3 | NCI-H292 IFN gamma | 30.4 |
| Two Way MLR 5 day | 7.4 | HPAEC none | 5.8 |
| Two Way MLR 7 day | 2.0 | HPAEC TNF alpha + IL-1 beta | 12.9 |
| PBMC rest | 1.7 | Lung fibroblast none | 23.8 |
| PBMC PWM | 12.5 | Lung fibroblast TNF alpha + IL-1 beta | 10.7 |
| PBMC PHA-L | 5.4 | Lung fibroblast IL-4 | 59.0 |
| Ramos (B cell) none | 0.5 | Lung fibroblast IL-9 | 40.6 |
| Ramos (B cell) ionomycin | 0.9 | Lung fibroblast IL-13 | 31.0 |
| B lymphocytes PWM | 15.6 | Lung fibroblast IFN gamma | 65.5 |
| B lymphocytes CD40L and IL-4 | 5.8 | Dermal fibroblast CCD1070 rest | 37.4 |
| EOL-1 dbcAMP | 3.5 | Dermal fibroblast CCD1070 TNF alpha | 50.0 |
| EOL-1 dbcAMP PMA/ionomycin | 60.3 | Dermal fibroblast CCD1070 IL-1 beta | 19.6 |
| Dendritic cells none | 17.6 | Dermal fibroblast IFN gamma | 15.0 |

TABLE 80-continued

Panel 4D

| Tissue Name | Rel. Exp. (%) Ag2011, Run 160997385 | Tissue Name | Rel. Exp. (%) Ag2011, Run 160997385 |
|---|---|---|---|
| Dendritic cells LPS | 32.5 | Dermal fibroblast IL-4 | 43.8 |
| Dendritic cells anti-CD40 | 21.0 | IBD Colitis 2 | 0.3 |
| Monocytes rest | 0.1 | IBD Crohn's | 0.8 |
| Monocytes LPS | 8.4 | Colon | 5.3 |
| Macrophages rest | 34.2 | Lung | 15.0 |
| Macrophages LPS | 11.3 | Thymus | 5.8 |
| HUVEC none | 6.5 | Kidney | 11.4 |
| HUVEC starved | 9.3 | | |

Panel 1.3D Summary: Ag1586/Ag2011

Two experiments with the same probe and primer set produce results that are in excellent agreement. NOV12 appears to be expressed largely in cancer cell lines, with highest expression in a melanoma cell line (CTs=26–28). Of note is the expression associated with colon cancer cell lines as well as melanoma cell lines. Thus, the expression of thie gene could be used to distinguish these samples from other samples on the panel. Moreover, therapeutic modulation of this gene, through the use of small molecule drugs, antibodies or protein therapeutics might be of use in the treatment of colon cancer or melanoma.

This gene is modestly expressed in a variety of metabolic tissues including pancreas, adrenal, thyroid, pituitary, fetal liver, and adipose. Thus, this gene product may be an antibody target for the treatment of metabolic disease, including obesity and diabetes, in any or all of these tissues. In addition, NOV12 is differentially expressed in fetal (CT values=26–28) versus adult heart (CT values=31–33), and in fetal (CT values=26–28) versus adult skeletal muscle (CT values=32–33), and may be used to differentiate between the adult and fetal sources of these tissues. Furthermore, the higher levels of expression in the fetal tissues suggest that the SC132340676_A gene product may be involved in the development of heart and skeletal muscle tissue. Thus, therapeutic modulation of the expression or function of the protein encoded by the SC132340676_A gene may be beneficial in the treatment of diseases that result in weak or dystrophic heart or skeletal muscle tissue, including ardiomyopathy, atherosclerosis, hypertension, congenital heart defects, aortic stenosis, atrial septal defect (ASD), atrioventricular (A-V) canal defect, ductus arteriosus, pulmonary stenosis, subaortic stenosis, ventricular septal defect (VSD), valve diseases, muscular dystrophy, Lesch-Nyhan syndrome, and myasthenia gravis.

This gene represents a novel protein with homology to a plexin that is expressed at moderate to high levels in all brain regions examined. Plexins act as receptors for semaphorins in the CNS. The interactions of the semaphorins and their receptors are critical for axon guidance. Therefore, this gene product may be useful as a drug target in clinical conditions where axonal growth and/or compensatory synaptogenesis are desireable (spinal cord or head trauma, stroke, or neurodegenerative diseases such as Alzheimer's, Parkinson's, or Huntington's disease).

References:

1. Pasterkamp R J, Ruitenberg M J, Verhaagen J. Semaphorins and their receptors in olfactory axon guidance. Cell Mol Biol (Noisy-le-grand) 1999 September;45(6):763–79

The mammalian olfactory system is capable of discriminating among a large variety of odor molecules and is therefore essential for the identification of food, enemies and mating partners. The assembly and maintenance of olfactory connectivity have been shown to depend on the combinatorial actions of a variety of molecular signals, including extracellular matrix, cell adhesion and odorant receptor molecules. Recent studies have identified semaphorins and their receptors as putative molecular cues involved in olfactory pathfinding, plasticity and regeneration. The semaphorins comprise a large family of secreted and transmembrane axon guidance proteins, being either repulsive or attractive in nature. Neuropilins were shown to serve as receptors for secreted class 3 semaphorins, whereas members of the plexin family are receptors for class 1 and V (viral) semaphorins. The present review will discuss a role for semaphorins and their receptors in the establishment and maintenance of olfactory connectivity.

2. Murakami Y, Suto F, Shimizu M, Shinoda T, Kameyama T, Fujisawa H. Differential expression of plexin-A subfamily members in the mouse nervous system. Dev Dyn 2001 March;220(3):246–58

Plexins comprise a family of transmembrane proteins (the plexin family) which are expressed in nervous tissues. Some plexins have been shown to interact directly with secreted or transmembrane semaphorins, while plexins belonging to the A subfamily are suggested to make complexes with other membrane proteins, neuropilins, and propagate chemorepulsive signals of secreted semaphorins of class 3 into cells or neurons. Despite that much information has been gathered on the plexin-semaphorin interaction, the role of plexins in the nervous system is not well understood. To gain insight into the functions of plexins in the nervous system, we analyzed spatial and temporal expression patterns of three members of the plexin-A subfamily (plexin-A1, -A2, and -A3) in the developing mouse nervous system by in situ hybridization analysis in combination with immunohistochemistry. We show that the three plexins are differentially expressed in sensory receptors or neurons in a developmentally regulated manner, suggesting that a particular plexin or set of plexins is shared by neuronal elements and functions as the receptor for semaphorins to regulate neuronal development.

Panel 2.2 Summary: Ag2011

The expression of NOV12 appears to be highest in a sample derived from a melanoma metastasis. In addition, there is substantial expression in another melanoma sample. These results are in agreement with the results seen in Panel 1.3D, with significant expression detected in melanoma cell lines. Thus, the expression of this gene could be used to distinguish melanoma from other cancer types in this panel. Moreover, therapeutic modulation of this gene, through the use of small molecule drugs, antibodies or protein therapeutics might be of use in the treatment of melanoma.

Panel 2D Summary: Ag1586

The expression of NOV12 is highest in a sample derived from a metastasis of lung cancer. Thus, the expression of this gene could be used to distinguish this sample from the others in the panel. In addition, there is substantial expression in bladder cancer, when compared to its normal adjacent tissue, as well as in two samples of melanoma. Thus, the expression of this gene could be used to distinguish this bladder cancer from its normal adjacent tissue, or these melanomas from other samples. Moreover, therapeutic modulation of this gene, through the use of small molecule drugs, antibodies or protein therapeutics might be of use in the treatment of lung cancer, bladder cancer or melanoma.

Panel 4D Summary: Ag2011

Significant expression of the NOV12 transcript is found in small airway epithelium upon treatment with the pro-inflammatory cytokines TNF-a and IL-1b (CT=26.5), the muco-epidermoid cell line H 292 treated with IL-4 or IL-9, and in lung fibroblasts treated with IFN-g or IL-4. The constitutive expression of this transcript in these tissues is highly up-regulated by pro-inflammatory cytokines or in conditions reflecting a Th2 mediated mechanism. Therefore, modulation of the expression of the protein encoded by this transcript could be useful for the treatment of lung inflammatory diseases that result from infection of the lung (bronchitis, pneumonia) and for the treatment of Th2-mediated lung disease such as asthma or COPD. Significant expression of this transcript is also found in eosinophils upon PMA and ionomycin treatment, conditions that lead to production of eosinophil specific mediators. This production could contribute to the pathologies associated with asthma, other atopic diseases and inflammatory bowel disease. This gene encodes a novel protein with homology to members of the plexin family, a family of transmembrane proteins which act as receptors for semaphorins. In neurons, semaphorins provide essential attractive and repulsive cues that are necessary for axon guidance. The description of the interaction of plexin wih tyrosine kinase in the fetal lung suggests that this protein may play a role not only in morphogenesis but also in proliferation of activation. (See reference below.) Therefore, modulation of the experession of this protein by either antibody or small molecules could be beneficial for the treatment of inflammatory lung, bowel and skin diseases.

References:

1. Cell 1999 Oct. 1;99(1):71–80

Plexins are a large family of receptors for transmembrane, secreted, and GPI-anchored semaphorins in vertebrates.

Tamagnone L, Artigiani S, Chen H, He Z, Ming G I, Song H, Chedotal A, Winberg M L, Goodman C S, Poo M, Tessier-Lavigne M, Comoglio P M.

Institute for Cancer Research and Treatment, University of Torino, Candiolo, Italy. ltamagnone@ircc.unito.it In *Drosophila*, plexin A is a functional receptor for semaphorin-1a. Here we show that the human plexin gene family comprises at least nine members in four subfamilies. Plexin-B1 is a receptor for the transmembrane semaphorin Sema4D (CD100), and plexin-C1 is a receptor for the GPI-anchored semaphorin Sema7A (Sema-K1). Secreted (class 3) semaphorins do not bind directly to plexins, but rather plexins associate with neuropilins, coreceptors for these semaphorins. Plexins are widely expressed: in neurons, the expression of a truncated plexin-A1 protein blocks axon repulsion by Sema3A. The cytoplasmic domain of plexins associates with a tyrosine kinase activity. Plexins may also act as ligands mediating repulsion in epithelial cells in vitro. We conclude that plexins are receptors for multiple (and perhaps all) classes of semaphorins, either alone or in combination with neuropilins, and trigger a novel signal transduction pathway controlling cell repulsion

PMID: 10520995

Example 3

SNP Analysis of NOVX Clones

SeqCalling™ Technology: cDNA was derived from various human samples representing multiple tissue types, normal and diseased states, physiological states, and developmental states from different donors. Samples were obtained as whole tissue, cell lines, primary cells or tissue cultured primary cells and cell lines. Cells and cell lines may have been treated with biological or chemical agents that regulate gene expression for example, growth factors, chemokines, steroids. The cDNA thus derived was then sequenced using CuraGen's proprietary SeqCalling technology. Sequence traces were evaluated manually and edited for corrections if appropriate. cDNA sequences from all samples were assembled with themselves and with public ESTs using bioinformatics programs to generate CuraGen's human Seq-Calling database of SeqCalling assemblies. Each assembly contains one or more overlapping cDNA sequences derived from one or more human samples. Fragments and ESTs were included as components for an assembly when the extent of identity with another component of the assembly was at least 95% over 50 bp. Each assembly can represent a gene and/or its variants such as splice forms and/or single nucleotide polymorphisms (SNPs) and their combinations.

Variant sequences are included in this application. A variant sequence can include a single nucleotide polymorphism (SNP). A SNP can, in some instances, be referred to as a "cSNP" to denote that the nucleotide sequence containing the SNP originates as a cDNA. A SNP can arise in several ways. For example, a SNP may be due to a substitution of one nucleotide for another at the polymorphic site. Such a substitution can be either a transition or a transversion. A SNP can also arise from a deletion of a nucleotide or an insertion of a nucleotide, relative to a reference allele. In this case, the polymorphic site is a site at which one allele bears a gap with respect to a particular nucleotide in another allele. SNPs occurring within genes may result in an alteration of the amino acid encoded by the gene at the position of the SNP. Intragenic SNPs may also be silent, however, in the case that a codon including a SNP encodes the same amino acid as a result of the redundancy of the genetic code. SNPs occurring outside the region of a gene, or in an intron within a gene, do not result in changes in any amino acid sequence of a protein but may result in altered regulation of the expression pattern for example, alteration in temporal expression, physiological response regulation, cell type expression regulation, intensity of expression, stability of transcribed message.

Method of novel SNP Identification: SNPs are identified by analyzing sequence assemblies using CuraGen's proprietary SNPTool algorithm. SNPTool identifies variation in assemblies with the following criteria: SNPs are not analyzed within 10 base pairs on both ends of an alignment; Window size (number of bases in a view) is 10; The allowed number of mismatches in a window is 2; Minimum SNP base quality (PHRED score) is 23; Minimum number of changes to score an SNP is 2/assembly position. SNPTool analyzes the assembly and displays SNP positions, associated individual variant sequences in the assembly, the depth of the assembly at that given position, the putative assembly allele frequency, and the SNP sequence variation. Sequence traces are then selected and brought into view for manual validation. The consensus assembly sequence is imported into CuraTools along with variant sequence changes to identify potential amino acid changes resulting from the SNP sequence variation. Comprehensive SNP data analysis is then exported into the SNPCalling database.

Method of novel SNP Confirmation: SNPs are confirmed employing a validated method know as Pyrosequencing (Pyrosequencing, Westborough, Mass.). Detailed protocols for Pyrosequencing can be found in: Alderborn et al. Determination of Single Nucleotide Polymorphisms by Real-time Pyrophosphate DNA Sequencing. (2000). *Genome Research*. 10, Issue 8, August. 1249–1265. In brief, Pyrosequencing is a real time primer extension process of genotyping. This protocol takes double-stranded, biotinylated PCR products from genomic DNA samples and binds them to streptavidin beads. These beads are then denatured producing single stranded bound DNA. SNPs are characterized utilizing a technique based on an indirect bioluminometric assay of pyrophosphate (PPi) that is released from each dNTP upon DNA chain elongation. Following Kienow polymerase-mediated base incorporation, PPi is released and used as a substrate, together with adenosine 5'-phosphosulfate (APS), for ATP sulfurylase, which results in the formation of ATP. Subsequently, the ATP accomplishes the conversion of luciferin to its oxi-derivative by the action of luciferase. The ensuing light output becomes proportional to the number of added bases, up to about four bases. To allow processivity of the method dNTP excess is degraded by apyrase, which is also present in the starting reaction mixture, so that only dNTPs are added to the template during the sequencing. The process has been fully automated and adapted to a 96-well format, which allows rapid screening of large SNP panels. The DNA and protein sequences for the novel single nucleotide polymorphic variants are reported. Variants are reported individually but any combination of all or a select subset of variants are also included. In addition, the positions of the variant bases and the variant amino acid residues are underlined.

Results

Variants are reported individually but any combination of all or a select subset of variants are also included as contemplated NOVX embodiments of the invention.

NOV6 SNP Data:

NOV6 has two SNP variants, whose variant positions for their nucleotide and amino acid sequences is numbered according to SEQ ID NOs:17 and 18, respectively. The nucleotide sequence of the NOV6 variants differs as shown in Table 81.

TABLE 81 cSNP and Coding Variants for NOV6

| NT Position of cSNP | Wild Type NT | Variant NT | Amino Acid position | Amino Acid Change |
|---|---|---|---|---|
| 446 | T | C | No change | No change |
| 553 | A | G | No change | No change |

NOV8 SNP Data:

NOV8 has two SNP variants, whose variant positions for their nucleotide and amino acid sequences is numbered according to SEQ ID NOs:21 and 22, respectively. The nucleotide sequence of the NOV8 variants differs as shown in Table 82.

TABLE 82 cSNP and Coding Variants for NOV8

| NT Position of cSNP | Wild Type NT | Variant NT | Amino Acid position | Amino Acid Change |
|---|---|---|---|---|
| 564 | G | A | 109 | G->D |
| 976 | T | G | No change | No change |

NOV9 SNP Data:

NOV 9 has two SNP variants, whose variant positions for their nucleotide and amino acid sequences is numbered according to SEQ ID NOs:23 and 24, respectively. The nucleotide sequence of the NOV9 variants differs as shown in Table 83.

TABLE 83 cSNP and Coding Variants for NOV9

| NT Position of cSNP | Wild Type NT | Variant NT | Amino Acid position | Amino Acid Change |
|---|---|---|---|---|
| 111 | A | C | No change | No change |
| 200 | A | G | 62 | K→R |

NOV10 SNP Data:

NOV10 has two SNP variants, whose variant positions for their nucleotide and amino acid sequences is numbered according to SEQ ID NOs:25 and 26, respectively. The nucleotide sequence of the NOV10 variants differs as shown in Table 84.

TABLE 84 cSNP and Coding Variants for NOV10

| NT Position of cSNP | Wild Type NT | Variant NT | Amino Acid position | Amino Acid Change |
|---|---|---|---|---|
| 2129 | C | T | No change | No change |
| 2450 | T | C | No change | No change |

NOV11 SNP Data:

NOV11a has three SNP variants, whose variant positions for their nucleotide and amino acid sequences is numbered according to SEQ ID NOs:27 and 28, respectively. The nucleotide sequence of the NOV11a variant differs as shown in Table 85.

TABLE 85 cSNP and Coding Variants for NOV11a

| NT Position of cSNP | Wild Type NT | Variant NT | Amino Acid position | Amino Acid Change |
|---|---|---|---|---|
| 122 | C | G | No change | No change |
| 208 | G | C | No change | No change |
| 372 | C | T | 97 | P->L |
| 482 | A | G | 134 | N->D |

Example 4

In-frame Cloning

NOV1b

For NOV1b, the cDNA coding for the DOMAIN of NOV1a (CG50718-02) from residues 18 to 917 was targeted for "in-frame" cloning by PCR. The PCR template was based on the previously identified plasmid, when available, or on human cDNA(s).

TABLE 86

Oligonucleotide primers used to clone the target cDNA sequence:

| Primers | Sequences | |
|---|---|---|
| F1 | 5'-AGATCTCAGGTAGATGTTTCCAATGTCGTTCC-3' | (SEQ ID NO:196) |
| R1 | 5'-CTCGAGGCTAGCGTTACATAAGCACTGTATTCAAC-3' | (SEQ ID NO:197) |

NOV11c

For NOV11c, the cDNA coding for the DOMAIN of NOV11b (CG54503_02) from residues 15 to 238 was targeted for "in-frame" cloning by PCR. The PCR template was based on the previously identified plasmid, when available, or on human cDNA(s).

TABLE 87

Oligonucleotide primers used to clone the target cDNA sequence:

| Primers | Sequences | |
|---|---|---|
| F2 | 5'-GGATCC TCCCGCGGGCCAGCGCACTACGAGATGCTGGGTCG-3' | (SEQ ID NO:198) |
| R1 | 5'-CTCGAGGTCGGGGTAGAT GATGAAGCCGGAGAAGGTGCTGTACTTGTTGG-3' | (SEQ ID NO:199) |

For downstream cloning purposes, the forward primer includes an in-frame Hind III restriction site and the reverse primer contains an in-frame Xho I restriction site.

Two parallel PCR reactions were set up using a total of 0.5–1.0 ng human pooled cDNAs as template for each reaction. The pool is composed of 5 micrograms of each of the following human tissue cDNAs: adrenal gland, whole brain, amygdala, cerebellum, thalamus, bone marrow, fetal brain, fetal kidney, fetal liver, fetal lung, heart, kidney, liver, lymphoma, Burkitt's Raji cell line, mammary gland, pancreas, pituitary gland, placenta, prostate, salivary gland, skeletal muscle, small Intestine, spleen, stomach, thyroid, trachea, uterus.

When the tissue of expression is known and available, the second PCR was performed using the above primers and 0.5 ng–1.0 ng of one of the following human tissue cDNAs:

skeleton muscle, testis, mammary gland, adrenal gland, ovary, colon, normal cerebellum, normal adipose, normal skin, bone marrow, brain amygdala, brain hippocampus, brain substantia nigra, brain thalamus, thyroid, fetal lung, fetal liver, fetal brain, kidney, heart, spleen, uterus, pituitary gland, lymph node, salivary gland, small intestine, prostate, placenta, spinal cord, peripheral blood, trachea, stomach, pancreas, hypothalamus.

The reaction mixtures contained 2 microliters of each of the primers (original concentration: 5 pmol/ul), 1 microliter of 10 mM dNTP (Clontech Laboratories, Palo Alto Calif.) and 1 microliter of 50×Advantage-HF 2 polymerase (Clontech Laboratories) in 50 microliter-reaction volume. The following reaction conditions were used:

PCR condition 1:
a) 96° C. 3 minutes
b) 96° C. 30 seconds denaturation
c) 60° C. 30 seconds, primer annealing
d) 72° C. 6 minutes extension Repeat steps b–d 15 times
e) 96° C. 15 seconds denaturation
f) 60° C. 30 seconds, primer annealing
g) 72° C. 6 minutes extension
Repeat steps e–g 29 times
c) 72° C. 10 minutes final extension
PCR condition 2:
a) 96° C. 3 minutes
b) 96° C. 15 seconds denaturation
c) 76° C. 30 seconds, primer annealing, reducing the temperature by 1° C. per cycle
d) 72° C. 4 minutes extension
Repeat steps b–d 34 times
e) 72° C. 10 minutes final extension An amplified product was detected by agarose gel electrophoresis. The fragment was gel-purified and ligated into the pCR2.1 vector (Invitrogen, Carlsbad, Calif.) following the manufacturer's recommendation. Twelve clones per PCR reaction were picked and sequenced. The inserts were sequenced using vector-specific M13 Forward and M13 Reverse primers and the gene-specific primers in Tables 88 and 89.

TABLE 88

Gene-specific Primers

| NOV | Primers | Sequences |
|---|---|---|
| NOV11c | SF1 | GCCCTCCCGGTCCAGGTC (SEQ ID NO:200) |
| | SF2 | GGCGACGGCACCAGCATGT (SEQ ID NO:201) |
| | SR1 | GCCTGGCCTGCCGGGTTCT (SEQ ID NO:202) |
| | SR2 | CATGAGCACGTGGTAAGCG (SEQ ID NO:203) |

TABLE 89

Gene-specific Primers

| NOV | Primers | Sequences |
|---|---|---|
| NOV1b | SF1 | (SEQ ID NO:204) GTGCTGGCATTGGAGTGTTTAGTG |

TABLE 89-continued

Gene-specific Primers

| NOV | Primers | Sequences |
|---|---|---|
| | SF2 | (SEQ ID NO:205) ATCAAGCACGTTGACACAGAATGAG |
| | SF3 | (SEQ ID NO:206) GCATTCACTAACCTAACACCATTTACA |
| | SF4 | (SEQ ID NO:207) GTTCAGCAGAGATGTCGTCTGACCTTC |
| | SF5 | (SEQ ID NO:208) GGGATCCTCCAGATCCTGTATTTTT |
| | SF6 | (SEQ ID NO:209) TGAAGAACACATCAACAACAGACATAA |
| | SR1 | (SEQ ID NO:210) ACTGTTTTCAGCAGCTACCTTAATTTC |
| | SR1 | (SEQ ID NO:211) CTTGATGAATGTGTGGTACGCGAT |
| | SR3 | (SEQ ID NO:212) GTGAATGCAAACTTGAGGTCTTTTGT |
| | SR4 | (SEQ ID NO:213) CCTCATATAATCCTACCATTGGCTGTACT |
| | 5R5 | (SEQ ID NO:214) GAGGATCCCAGTGTAAAAATACTTCTG |
| | SR6 | (SEQ ID NO:215) TAGCACTTCATAAGCAATAATGATCCC |
| | SR7 | (SEQ ID NO:216) TGAGTGTACTAGCAGACACCTCAATGAT |

OTHER EMBODIMENTS

Although particular embodiments have been disclosed herein in detail, this has been done by way of example for purposes of illustration only, and is not intended to be limiting with respect to the scope of the appended claims, which follow. In particular, it is contemplated by the inventors that various substitutions, alterations, and modifications may be made to the invention without departing from the spirit and scope of the invention as defined by the claims. The choice of nucleic acid starting material, clone of interest, or library type is believed to be a matter of routine for a person of ordinary skill in the art with knowledge of the embodiments described herein. Other aspects, advantages, and modifications considered to be within the scope of the following claims.

SEQUENCE LISTING (220 sequences)

SEQ ID NO: 1 - DNA, 2860 bp, Homo sapiens
  CDS (59)..(2857)
agactggggccagggagacagccctgggggagaggcgcccgaaccaggccgcgggagcatgggggcccggagcggagctcggggcgcgctgctgctggcactgctgctctgctgggacccgaggctgagccaagcaggcactgattctggcagcgaggtgctccctgactccttcccgtcagcgccagcagagccgctgccctacttcctgcaggagccacaggacgcctacattgtgaagaacaagcctgtggagctccgctgccgcgccttccccgccacacagatctacttcaagtgcaacggcgagtgggtcagccagaacgaccacgtcacacaggaaggcctggatgaggccaccggtctgcgggtgcgcgaggtgcagatcgaggtgtcgcggcagcaggtggaggagctctttgggctggaggattactggtgccagtgcgtggcctggagctccgcgggcaccaccaagagtcgccgagcctacgtccgcatcgcctacctgcgcaagaacttcgatcaggagcctctgggcaaggaggtgcccctggaccatgaggttctcctgcagtgccgcccgccggagggggtgcctgtggccgaggtggaatggctcaagaatgaggatgtcatcgaccccacccaggacaccaacttcctgctcaccatcgaccacaacctcatcatccgccaggcccgcctgtcggacactgccaactatacctgcgtggccaagaacatcgtggccaaacgccggagcaccactgccaccgtcatcgtctacgtgaatggcggctggtccagctgggcagagtggtcaccctgctccaaccgctgtggccgaggctggcagaagcgcacccggacctgcaccaaccccgctccactcaacggaggggccttctgcgagggccaggcattccagaagaccgcctgcaccaccatctgcccagtcgatggggcgtggacggagtggagcaagtggtcagcctgcagcactgagtgtgcccactggcgtagccgcgagtgcatggcgcccccaccccagaacggaggccgtgactgcagcgggacgctgctcgactctaagaactgcacagatgggctgtgcatgcaactggaggcctcaggggatgcggcgctgtatgcggggctcgtggtggccatcttcgtggtcgtggcaatcctcatggcggtgggggtggtggtgtaccgccgcaactgccgtgacttcgacacagacatcactgactcatctgctgccctgactggtggtttccaccccgtcaactttaagacggcaaggcccagtaacccgcagctcctacacccctctgtgcctcctgacctgacagccagcgccggcatctaccgcggacccgtgtatgccctgcaggactccaccgacaaaatccccatgaccaactctcctctgctggaccccttacccagccttaaggtcaaggtctacagctccagcaccacgggctctgggccaggcctggcagatggggctgacctgctgggggtcttgccgcctggcacataccctagcgatttcgcccgggacacccacttcctgcacctgcgcagcgccagcctcggttcccagcagctcttgggcctgccccgagacccagggagcagcgtcagcggcacctttggctgcctgggtgggaggctcagcatccccggcacaggggtcagcttgctggtgcccaatggagccattccccagggcaagttctacgagatgtatctactcatcaacaaggcagaaagtaccctgccgctttcagaagggacccagacagtattgagcccctcggtgacctgtggacccacaggcctcctgctgtgccgccccgtcatcctcaccatgccccactgtgccgaagtcagtgcccgtgactggatctttcagctcaagacccaggcccaccagggccactgggaggaggtggtgaccctggatgaggagaccctgaacacaccctgctactgccagctggagcccagggcctgtcacatcctgctggaccagctgggcacctacgtgttcacgggcgagtcctattcccgctcagcagtcaagcggctccagctggccgtcttcgcccccgccctctgcacctccctggagtacagcctccgggtctactgcctggaggacacgcctgtagcactgaaggaggtgctggagctggagcggactctgggcggatacttggtggaggagccgaaaccgctaatgttcaaggacagttaccacaacctgcgcctctccctccatgacctcccccatgcccattggaggagcaagctgctggccaaataccaggagatccccttctatcacatttggagtggcagccagaaggccctccactgcactttcaccctggagaggcacagcttggcctccacagagctcacctgcaagatctgcgtgcggcaagtggaaggggagggccagatattccagctgcataccactctggcagagacacctgctggctccctggacactctctgctctgcccctggcagcactgtcaccacccagctgggaccttatgccttcaagatcccactgtccatccgccagaagatatgcaacagcctagatgcccccaactcacggggcaatgactggcggatgttagcacagaagctctctatggaccggtacctgaattactttgccaccaaagcgagccccacgggtgtgatcctggacctctgggaagctctgcagcaggacgatggggacctcaacagcctggcgagtgccttggaggagatgggcaagagtgagatgctggtggctgtggccaccgacggggactgctga

SEQ ID NO: 2 - protein, 933 aa, Homo sapiens
MGARSGARGALLLALLLCWDPRLSQAGTDSGSEVLPDSFPSAPAEPLPYFLQEPQDAYIVKNKPVELRCRAFPATQIYFKCNGEWVSQNDHVTQEGLDEATGLRVREVQIEVSRQQVEELFGLEDYWCQCVAWSSAGTTKSRRAYVRIAYLRKNFDQEPLGKEVPLDHEVLLQCRPPEGVPVAEVEWLKNEDVIDPTQDTNFLLTIDHNLIIRQARLSDTANYTCVAKNIVAKRRSTTATVIVYVNGGWSSWAEWSPCSNRCGRGWQKRTRTCTNPAPLNGGAFCEGQAFQKTACTTICPVDGAWTEWSKWSACSTECAHWRSRECMAPPPQNGGRDCSGTLLDSKNCTDGLCMQLEASGDAALYAGLVVAIFVVVAILMAVGVVVYRRNCRDFDTDITDSSAALTGGFHPVNFKTARPSNPQLLHPSVPPDLTASAGIYRGPVYALQDSTDKIPMTNSPLLDPLPSLKVKVYSSSTTGSGPGLADGADLLGVLPPGTYPSDFARDTHFLHLRSASLGSQQLLGLPRDPGSSVSGTFGCLGGRLSIPGTGVSLLVPNGAIPQGKFYEMYLLINKAESTLPLSEGTQTVLSPSVTCGPTGLLLCRPVILTMPHCAEVSARDWIFQLKTQAHQGHWEEVVTLDEETLNTPCYCQLEPRACHILLDQLGTYVFTGESYSRSAVKRLQLAVFAPALCTSLEYSLRVYCLEDTPVALKEVLELERTLGGYLVEEPKPLMFKDSYHNLRLSLHDLPHAHWRSKLLAKYQEIPFYHIWSGSQKALHCTFTLERHSLASTELTCKICVRQVEGEGQIFQLHTTLAETPAGSLDTLCSAPGSTVTTQLGPYAFKIPLSIRQKICNSLDAPNSRGNDWRMLAQKLSMDRYLNYFATKASPTGVILDLWEALQQDDGDLNSLASALEEMGKSEMLVAVATDGDC

SEQ ID NO: 3 - DNA, 2860 bp, Homo sapiens
  CDS (59)..(2857)
agactggggccagggagacagccctgggggagaggcgcccgaaccaggccgcgggaacatgggggcccggagcggagctcggggcgcgctgctgctggcactgctgctctgctgggacccgaggctgagccaagcaggcactgattctggcagcgaggtgctccctgactccttcccgtcagcgccagcagagccgctgccctacttcctgcaggagccacaggacgcctacattgtgaagaacaagcctgtggagcttcgctgccgcgccttccccgccacacagatctacttcaagtgcaacggcgagtgggtcagccagaacgaccacgtcacacaggaaggcctggatgaggccaccggcctgcgggtgcgcgaggtgcagatcgaggtgtcgcggcagcaggtggaggagctctttgggctggaggattactggtgccagtgcgtggcctggagctccgcaggcaccaccaagagtcgccgagcctacgtccgcatcgcctacctgcgcaagaacttcgatcaggagcctctgggcaaggaggtgcccctggaccatgaggttctcctgcagtgccgcccgccggagggggtgcctgtggccgaggtggaatggctcaagaatgaggatgtcatcgaccccacccaggacaccaacttcctgctcaccatcgaccacaacctcatcatccgccaggcccgcctgtcggacactgccaactatacctgcgtggccaagaacatcgtggccaaacgccggagcaccactgccaccgtcatcgtctacgtgaatggcggctggtccagctgggcagagtggtcaccctgctccaaccgctgtggccgaggctggcagaagcgcacccggacctgcaccaaccccgctccactcaacggaggggccttctgcgagggccaggcattccagaagaccgcctgcaccaccatctgcccagtcgatggggcgtggacggagtggagcaagtggtcagcctgcagcactgagtgtgcccactggcgtagccgcgagtgcatggcgcccccaccccagaacggaggccgtgactgcagcgggacgctgctcgactctaagaactgcacagatgggctgtgcatgcaactggaggcctcaggggatgcggcgctgtatgcggggctcgtggtggccatcttcgtggtcgtggcaatcctcatggcggtgggggtggtggtgtaccgccgcaactgccgtgacttcgacacagacatcactgactcatctgctgccctgactggtggtttccaccccgtcaactttaagacggcaaggcccagtaacccgcagctcctacacccctctgtgcctcctgacctgacagccagcgccggcatctaccgcggacccgtgtatgccctgcaggactccaccgacaaaatccccatgaccaactctcctctgctggaccccttacccagccttaaggtcaaggtctacagctccagcaccacgggctctgggccaggcctggcagatggggctgacctgctgggggtcttgccgcctggcacataccctagcgatttcgcccgggacacccacttcctgcacctgcgcagcgccagcctcggttcccagcagctcttgggcctgccccgagacccagggagcagcgtcagcggcacctttggctgcctgggtgggaggctcagcatccccggcacaggggtcagcttgctggtgcccaatggagccattccccagggcaagttctacgagatgtatctactcatcaacaaggcagaaagtaccctgccgctttcagaagggacccagacagtattgagcccctcggtgacctgtggacccacaggcctcctgctgtgccgccccgtcatcctcaccatgccccactgtgccgaagtcagtgcccgtgactggatctttcagctcaagacccaggcccaccagggccactgggaggaggtggtgaccctggatgaggagaccctgaacacaccctgctactgccagctggagcccagggcctgtcacatcctgctggaccagctgggcacctacgtgttcacgggcgagtcctattcccgctcagcagtcaagcggctccagctggccgtcttcgcccccgccctctgcacctccctggagtacagcctccgggtctactgcctggaggacacgcctgtagcactgaaggaggtgctggagctggagcggactctgggcggatacttggtggaggagccgaaaccgctaatgttcaaggacagttaccacaacctgcgcctctccctccatgacctcccccatgcccattggaggagcaagctgctggccaaataccaggagatccccttctatcacatttggagtggcagccagaaggccctccactgcactttcaccctggagaggcacagcttggcctccacagagctcacctgcaagatctgcgtgcggcaagtggaaggggagggccagatattccagctgcataccactctggcagagacacctgctggctccctggacactctctgctctgcccctggcagcactgtcaccacccagctgggaccttatgccttcaagatcccactgtccatccgccagaagatatgcaacagcctagatgcccccaactcacggggcaatgactggcggatgttagcacagaagctctctatggaccggtacctgaattactttgccaccaaagcgagccccacgggtgtgatcctggacctctgggaagctctgcagcaggacgatggggacctcaacagcctggcgagtgccttggaggagatgggcaagagtgagatgctggtggctgtggccaccgacggggactgctga

SEQ ID NO: 4 - protein, 933 aa, Homo sapiens; identical to SEQ ID NO: 2

SEQ ID NO: 5 - DNA, 6994 bp, Homo sapiens
  CDS (31)..(6873)
tgattctactggctgaaaaatgtaataaagatggattttcttatcatttttcttttactttttattgggacttcagagacacaggtagatgtttccaatgtcgttcctggtactaggtacgatataaccatctcttcaatttctacaacatacacctcacctgttactagaataggggcttctaatgaaccagggcctccagtcttcctagccggggaaagagtcggatctgctgggattcttctgtcttggaatacaccacctaatccaaatggaaggattatatcttacattgtcaaatataaggaagtttgtccgtggatgcaaacagtatatacacaagtcagatcaaagccagacagtctggaagttcttcttactaatcttaatcctggaacaacatatgaaattaaggtagctgctgaaaacagtgctggcattggagtgtttagtgatccatttctcttccaaactgcagaaagtgctccaggaaaagtggtggatttcacaggtgaggctgtcccgttcagcagtaagctgatgtggtatacctcggcaaccaaaaaaaaaattaccagcttcaagattagtgtcaagcataacagaagtgggatagtagtgaaagaagtgtcaatcagagtggagtgcattttaagtgcttcccttcctttgcactgcaacgagaatagtgaatcttttttatggagtacagccagcccttctccaacccttggtagagttacacctccatcgcgtaccacacattcatcaagcacgttgacacagaatgagatcagctctgtgaaagagcctatcagttttgtagtgacacacttgagaccttatacaacatatctttttgaagtttcagctgctacaactgaagcaggttatattgatagtacgattgtcagaacaccagaatcagtgcctgaaggaccaccacaaaactgcgtaacaggcaacatcacaggaaagtccttttcaattttatgggacccaccaactatagtaacagggaaatttagttatagagttgaattatatggaccatcagcaggtcgcattttggataacagcacaaaagacctcaagtttgcattcactaacctaacaccatttacaatgtatgatgtctatattgcggctgaaaccagtgcagggactgggcccaagtcaaatatttcagtattcactccaccagatgttccaggggcagtgtttgatttacaacttgcagaggtagaatccacgcaagtaagaattacttggaagaaaccacgacaaccaaatggaattattaaccaataccgagtgaaagtgctagttccagagacaggaataattttggaaaatactttgctcactggaaataatgagataaatgaccccatggctccagaaattgtgaacatagtacagccaatggtaggattatatgagggttcagcagagatgtcgtctgaccttcactcacttgctacatttatatataacagccatccagataaaaactttcctgcaaggaatagagctgaagaccagacttcaccagttgtaactacaaggaatcagtatattactgacattgcagctgaacagctgacttatgttcttatcagattaaggagattttgggctgagacaatggggttttctagatatacaatcatgtcatctgcaagcagggacaatttgacttccccaggccctttgtcagcccaaaatttcagagttacacatgttaccataacagaagtatttttacactgggatcctccagatcctgtattttttcatcattaccttatcactattttggatgttgaaaaccaatccaagagtattattttaaggacattaaacagtttgtctcttgtccttatagggttaaagaaatacacaaaatacaaaatgagagtggcagcctcaacccacgttggagaaagttctttgtctgaagaaaatgacatctttgtgagaacttcagaagatgaaccggaatcatcacctcaagatgtcgaagtaattgatgttaccgcagatgaaataaggttgaagtggtcaccacccgaaaagcccaatgggatcattattgcttatgaagtgctatataaaaatatagatactttatatatgaagaacacatcaacaacagacataatattaaggaacttaagacctcacaccctctataacatttctgtaaggtcttacaccagatttggtcatggcaatcaggtatcttctttactctctgtaaggacttcggagtcagtgcctgatagtgcaccagaaaatatcacttacaaaaatatttcttctggagagattgagctatcattccttcccccaagtagtcccaatggaatcatacaaaaatatacaatttatctcaagagaagtaatggaaatgaggaaagaactataaatacaacctctttaacccaaaacattaaaggtctgaagaaatatacccaatatatcattgaggtgtctgctagtacactcaaaggtgaaggagttcggagtgctcccataagtatactgacggaggaagatgctcctgattctccccctcaagacttctctgtaaaacagttgtctggtgtcacggtgaagttgtcatggcaaccacccctggagccaaatggaattatcctttattacacagtttatgtctggagatcatcattaaaaactattaatgtcactgaaacatcattggagttatcagatttggattataatgttgaatacagtgcttatgtaacagctagcaccagatttggtgatgggaaaacaagaagcaatatcattagctttcaaacaccagagggaccaagcgatcctcccaaagatgtttattatgcaaacctcagttcttcatcaataattcttttctggacacctccttcaaaacctaatgggattatacaatattactctgtttattacagaaatacttcaggtacttttatgcagaattttacactccatgaagtaaccaatgactttgacaatatgactgtatccacaattatagataaactgacaatattcagctactatacattttggttaacagcaagtacttcagttggaaatgggaataaaagcagtgacatcattgaagtatacacagatcaagacgtacctgaagggtttgttggaaacctgacttacgaatccatttcgtcaactgcaataaatgtaagctgggtcccaccggctcaaccaaacggtctagtcttctactatgtttcactgatcttacagcagactcctcgccatgtgagaccacctcttgttacatatgagagaagcatatattttgataatctggaaaaatacactgattatatattaaaaattactccatcaacagaaaagggattctctgatacctatactgcccagctatacatcaagactgaagaagatatcccagaaacttcaccaataatcaacacttttaaaaacctttcctctacctcagttctcttatcatgggatcccccagtaaagccaaatggtgcaataataagttatgatttaactttacaaggaccaaatgaaaattattctttcattacttctgataattacataatattggaagagctttcaccatttacattatatagcttttttgctgccgcaagaactagaaaaggacttggtccttccagtattcttttcttttacacagatgagtcagtgccgttagcacctccacaaaatttgactttaatcaactgtacttcagactttgtatggctgaaatggagcccaagtcctcttccaggtggtattgttaaagtatatagttttaaaattcatgaacatgaaactgacactatatattataagaatatatcaggatttaaaactgaagccaaacttgttggactggaaccagtcagcacctactctatccgtgtatctgcgttcaccaaagttggaaatggcaatcaatttagtaatgtagtaaaattcacaacccaagaatcagttccagatgtcgtgcagaatatgcagtgcatggcaactagctggcagtcagttttagtgaaatgggatccacccaaaaaggcaaatggaataataacgcagtatatggtaacagttgaaaggaattctacaaaagtttctccccaagatcacatgtacactttcataaagcttcttgccaatacctcatatgtctttaaagtaagagcttcaacctcagctggtgaaggtgatgaaagcacatgccatgtcagcacactacctgaaacagttcccagtgttcccacaaatattgctttttctgatgttcagtcaactagtgcaacattgacatggataagacctgacactatccttggctactttcaaaattacaaaattaccactcaacttcgtgctcaaaaatgcaaagaatgggaatccgaagaatgtgttgaatatcaaaaaattcaatacctctatgaagctcacttaactgaagagacagtatatggattaaagaaatttagatggtatagattccaagtggctgccagcaccaatgctggctatggcaatgcttcaaactggatttctacaaaaactctgcctggccctccagatggtcctcctgaaaatgttcatgtagtagcaacatcaccttttagcatcagcataagctggagtgaacctgctgtcattactggaccaacatgttatctgattgatgtcaaatcggtagataatgatgaatttaatatatccttcatcaagtcaaatgaagaaaataaaaccatagaaattaaagatttagaaatattcacaaggtattctgtagtgatcactgcatttactgggaacattagtgctgcatatgtagaagggaagtcaagtgctgaaatgattgttactactttagaatcagccccaaaggacccacctaacaacatgacatttcagaagataccagatgaagttacaaaatttcaattaacgttccttcctccttctcaacctaatggaaatatccaagtatatcaagctctggtttaccgagaagatgatcctactgctgtccagattcacaacctcagtattatacagaaaaccaacacattcgtcattgcaatgctagaaggactaaaaggtggacatacatacaatatcagtgtttacgcagtcaatagtgctggtgcaggtccaaaggttccgatgagaataaccatggatatcaaagctccagcacgaccaaaaaccaaaccaacccctatttatgatgccacaggaaaactgcttgtgacttcaacaacaattacaatcagaatgccaatatgttactacagtgatgatcatggaccaataaaaaatgtacaagtgcttgtgacagaaacaggagctcagcatgatggaaatgtaacaaagtggtatgatgcatattttaataaagcaaggccatattttacaaatgaaggctttcctaaccctccatgtacagaaggaaagacaaagtttagtggcaatgaagaaatctacatcataggtgctgataatgcatgcatgattcctggcaatgaagacaaaatttgcaatggaccactgaaaccaaaaaagcaatacttatttaaatttagagctacaaatattatgggacaatttactgactctgattattctgaccctgttaagactttaggcgaaggactttcagaaagaaccgtagagatcattctttccgtcactttgtgtatcctttcaataattctccttggaacagctatttttgcatttgcaagaattcgacagaagcagaaagaaggtggcacatactctcctcaggatgcagaaattattgacactaaattgaagctggatcagctcatcacagtggcagacctggaactgaaggacgagagattaacgcggccaataagcaagaaatccttcctgcaacatgttgaagagctttgcacaaacaacaacctaaagtttcaagaagaattttcggaattaccaaaatttcttcaggatctttcttcaactgatgctgatctgccttggaatagagcaaaaaaccgcttcccaaacataaaaccatataataataacagagtaaagctgatagctgacgctagtgttccaggttcggattatattaatgccagctatatttctggttatttatgtccaaatgaatttattgctactcaaggtccactaccaggaacagttggagatttttggagaatggtgtgggaaaccagagcaaaaacattagtaatgctaacacagtgttttgaaaaaggacggatcagatgccatcagtattggccagaggacaacaagccagttactgtctttggagatatagtgattacaaagctaatggaggatgttcaaatagattggactatcagggatctgaaaattgaaaggcatggggattgcatgactgttcgacagtgtaactttactgcctggccagagcatggggttcctgagaacagcgcccctctaattcactttgtgaagttggttcgagcaagcagggcacatgacaccacacctatgattgttcactgcagtgctggagttggaagaactggagtttttattgctctggaccatttaacacaacatataaatgaccatgattttgtggatatatatggactagtagctgaactgagaagtgaaagaatgtgcatggtgcagaatctggcacagtatatctttttacaccagtgcattctggatctcttatcaaataagggaagtaatcagcccatctgttttgttaactattcagcacttcagaagatggactctttggacgccatggaaggtggtgatgttgagcttgaatgggaagaaaccactatgtaaatattcagaccaaaggatacaattggaagagatttttaaatcccaggggccaaagttaccccctcattcttccgaattgaaatgtgcaaccttaaagaaatatctatgcttctctcac

SEQ ID NO: 6 - protein, 2281 aa, Homo sapiens
MDFLIIFLLLFIGTSETQVDVSNVVPGTRYDITISSISTTYTSPVTRIGASNEPGPPVFLAGERVGSAGILLSWNTPPNPNGRIISYIVKYKEVCPWMQTVYTQVRSKPDSLEVLLTNLNPGTTYEIKVAAENSAGIGVFSDPFLFQTAESAPGKVVDFTGEAVPFSSKLMWYTSATKKKITSFKISVKHNRSGIVVKEVSIRVECILSASLPLHCNENSESFLWSTASPSPTLGRVTPPSRTTHSSSTLTQNEISSVKEPISFVVTHLRPYTTYLFEVSAATTEAGYIDSTIVRTPESVPEGPPQNCVTGNITGKSFSILWDPPTIVTGKFSYRVELYGPSAGRILDNSTKDLKFAFTNLTPFTMYDVYIAAETSAGTGPKSNISVFTPPDVPGAVFDLQLAEVESTQVRITWKKPRQPNGIINQYRVKVLVPETGIILENTLLTGNNEINDPMAPEIVNIVQPMVGLYEGSAEMSSDLHSLATFIYNSHPDKNFPARNRAEDQTSPVVTTRNQYITDIAAEQLTYVLIRLRRFWAETMGFSRYTIMSSASRDNLTSPGPLSAQNFRVTHVTITEVFLHWDPPDPVFFHHYLITILDVENQSKSIILRTLNSLSLVLIGLKKYTKYKMRVAASTHVGESSLSEENDIFVRTSEDEPESSPQDVEVIDVTADEIRLKWSPPEKPNGIIIAYEVLYKNIDTLYMKNTSTTDIILRNLRPHTLYNISVRSYTRFGHGNQVSSLLSVRTSESVPDSAPENITYKNISSGEIELSFLPPSSPNGIIQKYTIYLKRSNGNEERTINTTSLTQNIKGLKKYTQYIIEVSASTLKGEGVRSAPISILTEEDAPDSPPQDFSVKQLSGVTVKLSWQPPLEPNGIILYYTVYVWRSSLKTINVTETSLELSDLDYNVEYSAYVTASTRFGDGKTRSNIISFQTPEGPSDPPKDVYYANLSSSSIILFWTPPSKPNGIIQYYSVYYRNTSGTFMQNFTLHEVTNDFDNMTVSTIIDKLTIFSYYTFWLTASTSVGNGNKSSDIIEVYTDQDVPEGFVGNLTYESISSTAINVSWVPPAQPNGLVFYYVSLILQQTPRHVRPPLVTYERSIYFDNLEKYTDYILKITPSTEKGFSDTYTAQLYIKTEEDIPETSPIINTFKNLSSTSVLLSWDPPVKPNGAIISYDLTLQGPNENYSFITSDNYIILEELSPFTLYSFFAAARTRKGLGPSSILFFYTDESVPLAPPQNLTLINCTSDFVWLKWSPSPLPGGIVKVYSFKIHEHETDTIYYKNISGFKTEAKLVGLEPVSTYSIRVSAFTKVGNGNQFSNVVKFTTQESVPDVVQNMQCMATSWQSVLVKWDPPKKANGIITQYMVTVERNSTKVSPQDHMYTFIKLLANTSYVFKVRASTSAGEGDESTCHVSTLPETVPSVPTNIAFSDVQSTSATLTWIRPDTILGYFQNYKITTQLRAQKCKEWESEECVEYQKIQYLYEAHLTEETVYGLKKFRWYRFQVAASTNAGYGNASNWISTKTLPGPPDGPPENVHVVATSPFSISISWSEPAVITGPTCYLIDVKSVDNDEFNISFIKSNEENKTIEIKDLEIFTRYSVVITAFTGNISAAYVEGKSSAEMIVTTLESAPKDPPNNMTFQKIPDEVTKFQLTFLPPSQPNGNIQVYQALVYREDDPTAVQIHNLSIIQKTNTFVIAMLEGLKGGHTYNISVYAVNSAGAGPKVPMRITMDIKAPARPKTKPTPIYDATGKLLVTSTTITIRMPICYYSDDHGPIKNVQVLVTETGAQHDGNVTKWYDAYFNKARPYFTNEGFPNPPCTEGKTKFSGNEEIYIIGADNACMIPGNEDKICNGPLKPKKQYLFKFRATNIMGQFTDSDYSDPVKTLGEGLSERTVEIILSVTLCILSIILLGTAIFAFARIRQKQKEGGTYSPQDAEIIDTKLKLDQLITVADLELKDERLTRPISKKSFLQHVEELCTNNNLKFQEEFSELPKFLQDLSSTDADLPWNRAKNRFPNIKPYNNNRVKLIADASVPGSDYINASYISGYLCPNEFIATQGPLPGTVGDFWRMVWETRAKTLVMLTQCFEKGRIRCHQYWPEDNKPVTVFGDIVITKLMEDVQIDWTIRDLKIERHGDCMTVRQCNFTAWPEHGVPENSAPLIHFVKLVRASRAHDTTPMIVHCSAGVGRTGVFIALDHLTQHINDHDFVDIYGLVAELRSERMCMVQNLAQYIFLHQCILDLLSNKGSNQPICFVNYSALQKMDSLDAMEGGDVELEWEETTM

SEQ ID NO: 7 - DNA, 2565 bp, Homo sapiens
  CDS (1)..(2565)
agatctcctgaagggtttgttggaaacctgacttacgaatccatttcgtcaactgcaataaatgtaagctgggtcccaccggctcaaccaaacggtctagtcttctactatgtttcactgatcttacagcagactcctcgccatgtgagaccacctcttgttacatatgagagaagcatatattttgataatctggaaaaatacactgattatatattaaaaattactccatcaacagaaaagggattctctgatacctatactgcccagctatacatcaagactgaagaagatgtcccagaaacttcaccaataatcaacacttttaaaaacctttcctctacctcagttctcttatcatgggatcccccagtaaagccaaatggtgcaataataagttatgatttaactttacaaggaccaaatgaaaattattctttcattacttctgataattacataatattggaagagctttcaccatttacattatatagcttttttgctgccgcaagaactagaaaaggacttggtccttccagtattcttttcttttacacagatgagtcagtgccgttagcacctccacaaaatttgactttaatcaactgtacttcagactttgtatggctgaaatggagcccaagtcctcttccaggtggtattgttaaagtatatagttttaaaattcatgaacatgaaactgacactatatattataagaatatatcaggatttaaaactgaagccaaacttgttggactggaaccagtcagcacctactctatccgtgtatctgcgttcaccaaagttggaaatggcaatcaatttagtaatgtagtaaaattcacaacccaagaatcagttccagatgtcgtgcagaatatgcagtgcatggcaactagctggcagtcagttttagtgaaatgggatccacccaaaaaggcaaatggaataataacgcagtatatggtaacagttgaaaggaattctacaaaagtttctccccaagatcacatgtacactttcataaagcttcttgccaatacctcatatgtctttaaagtaagagcttcaacctcagctggtgaaggtgatgaaagcacatgccatgtcagcacactacctgaaacagttcccagtgttcccacaaatattgctttttctgatgttcagtcaactagtgcaacattgacatggataagacctgacactatccttggctactttcaaaattacaaaattaccactcaacttcgtgctcaaaaatgcaaagaatgggaatccgaagaatgtgttgaatatcaaaaaattcaatacctctatgaagctcacttaactgaagagacagtatatggattaaagaaatttagatggtatagattccaagtggctgccagcaccaatgctggctatggcaatgcttcaaactggatttctacaaaaactctgcctggccctccagatggtcctcctgaaaatgttcatgtagtagcaacatcaccttttagcatcagcataagctggagtgaacctgctgtcattactggaccaacatgttatctgattgatgtcaaatcggtagataatgatgaatttaatatatccttcatcaagtcaaatgaagaaaataaaaccatagaaattaaagatttagaaatattcacaaggtattctgtagtgatcactgcatttactgggaacattagtgctgcatatgtagaagggaagtcaagtgctgaaatgattgttactactttagaatcagccccaaaggacccacctaacaacatgacatttcagaagataccagatgaagttacaaaatttcaattaacgtcccttcctccttctcaacctaatggaaatatccaagtatatcaagctctggtttaccgagaagatgatcctactgctgtccagattcacaacctcagtattatacagaaaaccaacacattcgtcattgcaatgctagaaggactaaaaggtggacatacatacaatatcagtgtttacgcagtcaatagtgctggtgcaggtccaaaggttccgatgagaataaccatggatatcaaagctccagcacgaccaaaaaccaaaccaacccctatttatgatgccacaggaaaactgcttgtgacttcaacaacaattacaatcagaatgccaatatgttactacagtgatgatcatggaccaataaaaaatgtacaagtgcttgtgacagaaacaggagctcagcatgatggaaatgtaacaaagtggtatgatgcatattttaataaagcaaggccatattttacaaatgaaggctttcctaaccctccatgtacagaaggaaagacaaagtttagtggcaatgaagaaatctacatcataggtgctgataatgcatgcatgattcctggcaatgaagacaaaatttgcaatggaccactgaaaccaaaaaagcaatacttatttaaatttagagctacaaatattatgggacaatttactgactctgattattctgaccctgttaagactttaggcgaaggactttcagaaagaaccctcgag

SEQ ID NO: 8 - protein, 855 aa, Homo sapiens
RSPEGFVGNLTYESISSTAINVSWVPPAQPNGLVFYYVSLILQQTPRHVRPPLVTYERSIYFDNLEKYTDYILKITPSTEKGFSDTYTAQLYIKTEEDVPETSPIINTFKNLSSTSVLLSWDPPVKPNGAIISYDLTLQGPNENYSFITSDNYIILEELSPFTLYSFFAAARTRKGLGPSSILFFYTDESVPLAPPQNLTLINCTSDFVWLKWSPSPLPGGIVKVYSFKIHEHETDTIYYKNISGFKTEAKLVGLEPVSTYSIRVSAFTKVGNGNQFSNVVKFTTQESVPDVVQNMQCMATSWQSVLVKWDPPKKANGIITQYMVTVERNSTKVSPQDHMYTFIKLLANTSYVFKVRASTSAGEGDESTCHVSTLPETVPSVPTNIAFSDVQSTSATLTWIRPDTILGYFQNYKITTQLRAQKCKEWESEECVEYQKIQYLYEAHLTEETVYGLKKFRWYRFQVAASTNAGYGNASNWISTKTLPGPPDGPPENVHVVATSPFSISISWSEPAVITGPTCYLIDVKSVDNDEFNISFIKSNEENKTIEIKDLEIFTRYSVVITAFTGNISAAYVEGKSSAEMIVTTLESAPKDPPNNMTFQKIPDEVTKFQLTSLPPSQPNGNIQVYQALVYREDDPTAVQIHNLSIIQKTNTFVIAMLEGLKGGHTYNISVYAVNSAGAGPKVPMRITMDIKAPARPKTKPTPIYDATGKLLVTSTTITIRMPICYYSDDHGPIKNVQVLVTETGAQHDGNVTKWYDAYFNKARPYFTNEGFPNPPCTEGKTKFSGNEEIYIIGADNACMIPGNEDKICNGPLKPKKQYLFKFRATNIMGQFTDSDYSDPVKTLGEGLSERTLE

SEQ ID NO: 9 - DNA, 6903 bp, Homo sapiens
  CDS (1)..(6900)
atggattttcttatcatttttcttttactttttattgggacttcagagacacaggtagatgtttccaatgtcgttcctggtactaggtacgatataaccatctcttcaatttctacaacatacacctcacctgttactagaatagtgacaacaaatgtaacagaaccagggcctccagtcttcctagccggggaaagagtcggatctgctgggattcttctgtcttggaatacaccacctaatccaaatggaaggattatatcttacattgtcaaatataaggaagtttgtccgtggatgcaaacagtatatacacaagtcagatcaaagccagacagtctggaagttcttcttactaatcttaatcctggaacaacatatgaaattaaggtagctgctgaaaacagtgctggcattggagtgtttagtgatccatttctcttccaaactgcagaaagtccagctccaggaaaagtggtgaatctcacagttgaggcctacaacgcttcagcagttaagctgatttggtatttacctcggcaaccaaatggcaaaattaccagcttcaagattagtgtcaagcatgccagaagtgggatagtagtgaaagatgtctcaatcagagtagaggacattttgactgggaaattgccagaatgcaatgtagagaatagtgaatcttttttatggagtacagccagcccttctccaacccttggtagagttacacctccatcgcgtaccacacattcatcaagcacgttgacacagaatgagatcagctctgtgtggaaagagcctatcagttttgtagtgacacacttgagaccttatacaacatatctttttgaagtttcagctgctacaactgaagcaggttatattgatagtacgattgtcagaacaccagaatcagtgcctgaaggaccaccacaaaactgcgtaacaggcaacatcacaggaaagtccttttcaattttatgggacccaccaactatagtaacagggaaatttagttatagagttgaattatatggaccatcaggtcgcattttggataacagcacaaaagacctcaagtttgcattcactaacctaacaccatttacaatgtatgatgtctatattgcggctgaaaccagtgcagggactgggcccaagtcaaatatttcagtattcactccaccagatgttccaggggcagtgtttgatttacaacttgcagaggtagaatccacgcaagtaagaattacttggaagaaaccacgacaaccaaatggaattattaaccaataccgagtgaaagtgctagttccagagacaggaataattttggaaaatactttgctcactggaaataatgagataaatgaccccatggctccagaaattgtgaacatagtagagccaatggtaggattatatgagggttcagcagagatgtcgtctgaccttcactcacttgctacatttatatataacagccatccagataaaaactttcctgcaaggaatagagctgaagaccagacttcaccagttgtaactacaaggaatcagtatattactgacattgcagctgaacagctgtcttatgttatcaggagacttgtacctttcactgagcacatgattagtgtatctgctttcaccatcatgggagaaggaccaccaacagttctcagtgttaggacacgtcagcaagtgccaagctccattaaaattataaactataaaaatattagttcttcatctattttgttatattgggatcctccagaatatcccaatggaaaaataactcactatacgatttatgcaatggaattggatacaaacagagcattccagataactaccatagataacagctttctcataacaggtatagggttaaagaaatacacaaaatacaaaatgagagtggcagcctcaacccacgttggagaaagttctttgtctgaagaaaatgacatctttgtgagaacttcagaagatgaaccggaatcatcacctcaagatgtcgaagtaattgatgttaccgcagatgaaataaggttgaagtggtcaccacccgaaaagcccaatgggatcattattgcttatgaagtgctatataaaaatatagatactttatatatgaagaacacatcaacaacagacataatattaaggaacttaagacctcacaccctctataacatttctgtaaggtcttacaccagatttggtcatggcaatcaggtatcttctttactctctgtaaggacttcggagactgtgcctgatagtgcaccagaaaatatcacttacaaaaatatttcttctggagagattgagctatcattccttcccccaagtagtcccaatggaatcatacaaaaatatacaatttatctcaagagaagtaatggaaatgaggaaagaactataaatacaacctctttaacccaaaacattctgaagaaatatacccaatatatcattgaggtgtctgctagtacactcaaaggtgaaggagttcggagtgctcccataagtatactgacggaggaagatgctcctgattctccccctcaagacttctctgtaaaacagttgtctggtgtcacggtgaagttgtcatggcaaccacccctggagccaaatggaattatcctttattacacagtttatgtctggaggaatagatcatcattaaaaactattaatgtcactgaaacatcattggagttatcagatttggattataatgttgaatacagtgcttatgtaacagctagcaccagatttggtgatgggaaaacaagaagcaatatcattagctttcaaacaccagagggaccaagcgatcctcccaaagatgtttattatgcaaacctcagttcttcatcaataattcttttctggacacctccttcaaaacctaatgggattatacaatattactctgtttattacagaaatacttcaggtacttttatgcagaattttacactccatgaagtaaccaatgactttgacaatatgactgtatccacaattatagataaactgacaatattcagctactatacattttggttaacagcaagtacttcagttggaaatgggaataaaagcagtgacatcattgaagtatacacagatcaagacgtccctgaagggtttgttggaaacctgacttacgaatccatttcgtcaactgcaataaatgtaagctgggtcccaccggctcaaccaaacggtctagtcttctactatgtttcactgatcttacagcagactcctcgccatgtgagaccacctcttgttacatatgagagaagcatatattttgataatctggaaaaatacactgattatatattaaaaattactccatcaacagaaaagggattctctgatacctatactgcccagctatacatcaagactgaagaagatgtcccagaaacttcaccaataatcaacacttttaaaaacctttcctctacctcagttctcttatcatgggatcccccagtaaagccaaatggtgcaataataagttatgatttaactttacaaggaccaaatgaaaattattctttcattacttctgataattacataatattggaagagctttcaccatttacattatatagcttttttgctgccgcaagaactagaaaaggacttggtccttccagtattcttttcttttacacagatgagtcagtgccgttagcacctccacaaaatttgactttaatcaactgtacttcagactttgtatggctgaaatggagcccaagtcctcttccaggtggtattgttaaagtatatagttttaaaattcatgaacatgaaactgacactatatattataagaatatatcaggatttaaaactgaagccaaacttgttggactggaaccagtcagcacctactctatccgtgtatctgcgttcaccaaagttggaaatggcaatcaatttagtaatgtagtaaaattcacaacccaagaatcagttccagatgtcgtgcagaatatgcagtgcatggcaactagctggcagtcagttttagtgaaatgggatccacccaaaaaggcaaatggaataataacgcagtatatggtaacagttgaaaggaattctacaaaagtttctccccaagatcacatgtacactttcataaagcttcttgccaatacctcatatgtctttaaagtaagagcttcaacctcagctggtgaaggtgatgaaagcacatgccatgtcagcacactacctgaaacagttcccagtgttcccacaaatattgctttttctgatgttcagtcaactagtgcaacattgacatggataagacctgacactatccttggctactttcaaaattacaaaattaccactcaacttcgtgctcaaaaatgcaaagaatgggaatccgaagaatgtgttgaatatcaaaaaattcaatacctctatgaagctcacttaactgaagagacagtatatggattaaagaaatttagatggtatagattccaagtggctgccagcaccaatgctggctatggcaatgcttcaaactggatttctacaaaaactctgcctggccctccagatggtcctcctgaaaatgttcatgtagtagcaacatcaccttttagcatcagcataagctggagtgaacctgctgtcattactggaccaacatgttatctgattgatgtcaaatcggtagataatgatgaatttaatatatccttcatcaagtcaaatgaagaaaataaaaccatagaaattaaagatttagaaatattcacaaggtattctgtagtgatcactgcatttactgggaacattagtgctgcatatgtagaagggaagtcaagtgctgaaatgattgttactactttagaatcagccccaaaggacccacctaacaacatgacatttcagaagataccagatgaagttacaaaatttcaattaacgtcccttcctccttctcaacctaatggaaatatccaagtatatcaagctctggtttaccgagaagatgatcctactgctgtccagattcacaacctcagtattatacagaaaaccaacacattcgtcattgcaatgctagaaggactaaaaggtggacatacatacaatatcagtgtttacgcagtcaatagtgctggtgcaggtccaaaggttccgatgagaataaccatggatatcaaagctccagcacgaccaaaaaccaaaccaacccctatttatgatgccacaggaaaactgcttgtgacttcaacaacaattacaatcagaatgccaatatgttactacagtgatgatcatggaccaataaaaaatgtacaagtgcttgtgacagaaacaggagctcagcatgatggaaatgtaacaaagtggtatgatgcatattttaataaagcaaggccatattttacaaatgaaggctttcctaaccctccatgtacagaaggaaagacaaagtttagtggcaatgaagaaatctacatcataggtgctgataatgcatgcatgattcctggcaatgaagacaaaatttgcaatggaccactgaaaccaaaaaagcaatacttatttaaatttagagctacaaatattatgggacaatttactgactctgattattctgaccctgttaagactttaggcgaaggactttcagaaagaaccctagagatcattctttccgtcactttgtgtatcctttcaataattctccttggaacagctatttttgcatttgcaagaattcgacagaagcagaaagaaggtggcacatactctcctcaggatgcagaaattattgacactaaattgaagctggatcagctcatcacagtggcagacctggaactgaaggacgagagattaacgcggttacttagttatagaaaatccatcaagccaataagcaagaaatccttcctgcaacatgttgaagagctttgcacaaacaacaacctaaagtttcaagaagaattttcggaattaccaaaatttcttcaggatctttcttcaactgatgctgatctgccttggaatagagcaaaaaaccgcttcccaaacataaaaccatataataataacagagtaaagctgatagctgacgctagtgttccaggttcggattatattaatgccagctatatttctggttatttatgtccaaatgaatttattgctactcaaggtccactaccaggaacagttggagatttttggagaatggtgtgggaaaccagagcaaaaacattagtaatgctaacacagtgttttgaaaaaggacggatcagatgccatcagtattggccagaggacaacaagccagttactgtctttggagatatagtgattacaaagctaatggaggatgttcaaatagattggactatcagggatctgaaaattgaaaggcatggggattgcatgactgttcgacagtgtaactttactgcctggccagagcatggggttcctgagaacagcgcccctctaattcactttgtgaagttggttcgagcaagcagggcacatgacaccacacctatgattgttcactgtagtgctggagttggaagaactggagtttttattgctctggaccatttaacacaacatataaatgaccatgattttgtggatatatatggactagtagctgaactgagaagtgaaagaatgtgcatggtgcagaatctggcacagtatatctttttacaccagtgcattctggatctcttatcaaataagggaagtaatcagcccatctgttttgttaactattcagcacttcagaagatggactctttggacgccatggaaggtgatgttgagcttgaatgggaagaaaccactatgtaa

SEQ ID NO: 10 - protein, 2300 aa, Homo sapiens
MDFLIIFLLLFIGTSETQVDVSNVVPGTRYDITISSISTTYTSPVTRIVTTNVTEPGPPVFLAGERVGSAGILLSWNTPPNPNGRIISYIVKYKEVCPWMQTVYTQVRSKPDSLEVLLTNLNPGTTYEIKVAAENSAGIGVFSDPFLFQTAESPAPGKVVNLTVEAYNASAVKLIWYLPRQPNGKITSFKISVKHARSGIVVKDVSIRVEDILTGKLPECNVENSESFLWSTASPSPTLGRVTPPSRTTHSSSTLTQNEISSVWKEPISFVVTHLRPYTTYLFEVSAATTEAGYIDSTIVRTPESVPEGPPQNCVTGNITGKSFSILWDPPTIVTGKFSYRVELYGPSGRILDNSTKDLKFAFTNLTPFTMYDVYIAAETSAGTGPKSNISVFTPPDVPGAVFDLQLAEVESTQVRITWKKPRQPNGIINQYRVKVLVPETGIILENTLLTGNNEINDPMAPEIVNIVEPMVGLYEGSAEMSSDLHSLATFIYNSHPDKNFPARNRAEDQTSPVVTTRNQYITDIAAEQLSYVIRRLVPFTEHMISVSAFTIMGEGPPTVLSVRTRQQVPSSIKIINYKNISSSSILLYWDPPEYPNGKITHYTIYAMELDTNRAFQITTIDNSFLITGIGLKKYTKYKMRVAASTHVGESSLSEENDIFVRTSEDEPESSPQDVEVIDVTADEIRLKWSPPEKPNGIIIAYEVLYKNIDTLYMKNTSTTDIILRNLRPHTLYNISVRSYTRFGHGNQVSSLLSVRTSETVPDSAPENITYKNISSGEIELSFLPPSSPNGIIQKYTIYLKRSNGNEERTINTTSLTQNILKKYTQYIIEVSASTLKGEGVRSAPISILTEEDAPDSPPQDFSVKQLSGVTVKLSWQPPLEPNGIILYYTVYVWRNRSSLKTINVTETSLELSDLDYNVEYSAYVTASTRFGDGKTRSNIISFQTPEGPSDPPKDVYYANLSSSSIILFWTPPSKPNGIIQYYSVYYRNTSGTFMQNFTLHEVTNDFDNMTVSTIIDKLTIFSYYTFWLTASTSVGNGNKSSDIIEVYTDQDVPEGFVGNLTYESISSTAINVSWVPPAQPNGLVFYYVSLILQQTPRHVRPPLVTYERSIYFDNLEKYTDYILKITPSTEKGFSDTYTAQLYIKTEEDVPETSPIINTFKNLSSTSVLLSWDPPVKPNGAIISYDLTLQGPNENYSFITSDNYIILEELSPFTLYSFFAAARTRKGLGPSSILFFYTDESVPLAPPQNLTLINCTSDFVWLKWSPSPLPGGIVKVYSFKIHEHETDTIYYKNISGFKTEAKLVGLEPVSTYSIRVSAFTKVGNGNQFSNVVKFTTQESVPDVVQNMQCMATSWQSVLVKWDPPKKANGIITQYMVTVERNSTKVSPQDHMYTFIKLLANTSYVFKVRASTSAGEGDESTCHVSTLPETVPSVPTNIAFSDVQSTSATLTWIRPDTILGYFQNYKITTQLRAQKCKEWESEECVEYQKIQYLYEAHLTEETVYGLKKFRWYRFQVAASTNAGYGNASNWISTKTLPGPPDGPPENVHVVATSPFSISISWSEPAVITGPTCYLIDVKSVDNDEFNISFIKSNEENKTIEIKDLEIFTRYSVVITAFTGNISAAYVEGKSSAEMIVTTLESAPKDPPNNMTFQKIPDEVTKFQLTSLPPSQPNGNIQVYQALVYREDDPTAVQIHNLSIIQKTNTFVIAMLEGLKGGHTYNISVYAVNSAGAGPKVPMRITMDIKAPARPKTKPTPIYDATGKLLVTSTTITIRMPICYYSDDHGPIKNVQVLVTETGAQHDGNVTKWYDAYFNKARPYFTNEGFPNPPCTEGKTKFSGNEEIYIIGADNACMIPGNEDKICNGPLKPKKQYLFKFRATNIMGQFTDSDYSDPVKTLGEGLSERTLEIILSVTLCILSIILLGTAIFAFARIRQKQKEGGTYSPQDAEIIDTKLKLDQLITVADLELKDERLTRLLSYRKSIKPISKKSFLQHVEELCTNNNLKFQEEFSELPKFLQDLSSTDADLPWNRAKNRFPNIKPYNNNRVKLIADASVPGSDYINASYISGYLCPNEFIATQGPLPGTVGDFWRMVWETRAKTLVMLTQCFEKGRIRCHQYWPEDNKPVTVFGDIVITKLMEDVQIDWTIRDLKIERHGDCMTVRQCNFTAWPEHGVPENSAPLIHFVKLVRASRAHDTTPMIVHCSAGVGRTGVFIALDHLTQHINDHDFVDIYGLVAELRSERMCMVQNLAQYIFLHQCILDLLSNKGSNQPICFVNYSALQKMDSLDAMEGDVELEWEETTM

SEQ ID NO: 11 - DNA, 4538 bp, Homo sapiens
  CDS (101)..(4438)
catgaaggaaaaattctgagtattctaatggctttttaaaataatcatttatttgctaggtaagttctcttctacgctgtatgagactggtggctgtgatatgtcacttgtgaattttgaaccagcagcaagaagagcatccaatatctgggacacagattctcatgtatccagttctacctcagttcgattttatccacatgatgtgattcgattgaatagactattgaccattgatacagatttgttggagcaacaggacattgatctaagccctgacttggcagctacttacggcccaacagaagaagctgcccaaaaggttaaacactattatcgcttttggatcctaccccagctgtggattggcattaactttgacagactcacacttttggccctgtttgataggaatcgtgagatcctggaaaatgtgttagctgtcatcctggctattctcgtggcctttttgggatctattcttctcatacaaggattcttcagagatatctgggtcttccagttctgcctcgtcatagccagctgtcaatactcactgcttaagagtgttcaaccagattcttcttctcccagacatggtcataatcgtatcattgcctacagtagaccagtttatttctgcatatgttgcggtcttatttggctcttggattatggtagcagaaacctgactgcaaccaagttcaaattatatggaataactttcaccaatccactggtgtttatatcagccagggatttagttatagtgtttacactctgtttcccaatagtgtttttcattggtctcctgcctcaggtgaatacatttgtaatgtacctttgtgaacaattggatattcatatttttggtggtaatgccactacaagcctgcttgcagcactttacagttttatctgtagcattgttgcagtagccttattgtatggattatgttatggggctttacaggattcttgggatggccagcatattccagtacttttctccattttttgtggtttattagtggcagtgtcttaccatctcagccgacaaagcagtgatccatctgtacttagctctttagtgcaatccaagatttttccaaaaacggaagagaaaaatccagaagaccctctatctgaagtaaaagatccactgcctgaaaaacttagaaattctgttagtgagcgattacagtctgacctggtagtatgcattgtaattggtgtgctgtattttgctattcatgtaagcacagtcttcacagtattgcagcctgccctcaagtatgtgttgtatacattggttggctttgtgggttttgtaacccattatgtgctgcctcaagttagaaaacagctaccatggcactgtttctctcatcctctgctaaagacactagagtataatcagtatgaagttcgagatgcagccactatgatgtggtttgagaaacttcatgtgtggcttctttttgtggagaagaatataatctatccattgattgttctcaatgaactgagcagcagtgcagagacaattgctagtccaaagaaactgaatacagagttaggtgctttaatgatcactgttgctggtttgaagttgctacgatcctcttttagcagccctacatatcagtatgttacagtcatctttactgtgctgtttttcaaatttgactatgaagctttttcagagaccatgctgttggatctcttctttatgtccatactcttcaacaagctttgggaactactttataaattgcagtttgtgtatacctatattgccccatggcagatcacatggggttctgctttccatgcttttgctcagccttttgcagtgcctcgttcagccatgctgtttattcaggctgctgtctcggccttcttctctactccactgaacccctttctgggaagtgcaatattcatcacttcatatgtccgacctgtgaaattctgggagagagactatagcacaaaacgagtggatcattcaaataccagattggcttcccagcttgatagaaatccaggttcagatgacaacaatctgaattccatcttttatgagcatttaactagatccctacagcacagcctctgtggtgatttgctactaggacggtggggaaactacagtacaggggactgtttcatccttgcctctgactatctcaatgcattagtacaccttatagagataggcaatggtctggtcacttttcagctgcggggacttgaattcagaggtacctactgtcaacaacgggaagtggaggccattactgaaggtgtagaggaagatgaaggattttgctgttgtgaacctggccatattcctcacatgctttcatttaatgctgcatttagccagcgatggctagcttgggaagtgatagtcacaaagtacattctggagggttatagcatcactgataacagtgctgcttctatgcttcaagtctttgatcttcggaaagtactcaccacttactatgtcaagggtatcatttattatgttacgacctcgtctaagctagaggagtggctagctaatgagacaatgcaggaaggacttcgtctgtgtgctgatcgcaattatgtcgatgtggacccgacctttaatccaaacattgatgaagactatgaccaccgactggcaggcatatctagggagagtttctgtgtgatttacctcaactggatagagtactgctcttcccgaagagcaaagcctgtggatgtggacaaagattcatccctagtgactctctgttatggactctgtgttctgggacggagagctttggggactgcatcccatcatatgtccagtaatttagagtcattcctctatggattgcatgccctatttaaaggagatttccgtatttcttcaattcgagatgaatggatctttgctgacatggaattgctaagaaaagtagtagtccctgggatccgtatgtccattaaacttcatcaggatcattttacttctccagatgaatatgatgaccctactgtgctctatgaagccatagtatctcatgagaagaacctcgtaatagcccatgaaggggaccctgcatggcggagtgcagtacttgccaactctccctccttgcttgctctgcggcatgtcatggatgatggcaccaatgaatataaaatcatcatgctcaacagacgctacctgagcttcagggtcattaaagtgaataaggaatgtgtccgaggtctttgggcagggcaacagcaggagcttgtttttctacgtaaccgtaacccagagagaggtagcatccaaaatgcaaagcaagccctgagaaacatgataaactcatcttgtgatcaacctattggctacccaatctttgtctcacccctgacaacttcttactctgacagccacgaacagcttaaagacattcttgggggtcctatcagcttgggaaatatcaggaacttcatagtgtcaacctggcacaggcttaggaaaggttgcggagctggatgtaacagtggtggcaatattgaagattctgatactggaggtgggacttcctgcactggtaacaatgcaacaactgccaacaatccccacagcaacgtgacccagggaagcattggaaatcctgggcagggatcaggaactggactccacccacctgtcacatcttatcctccaacactaggtactagccacagctctcactctgtgcagtcgggcctggtcagacagtctcctgcccgggcctcagtagccagccagtcttcctactgctatagcagccggcattcatccctccggatgtccaccactgggtttgtgccttgtcggcgctcttctactagtcagatatcgcttcgaaacttgccatcatccatccaatcccgactgtcgatggtgaaccaaatggaaccctcaggtcagagcggcctggcctgtgtgcagcacggcctgccttcctccagcagctccagccaaagcatcccagcctgcaaacatcacactctcgtgggctttcttgcgacagagggaggtcagagcagtgccactgatgcacagccaggcaacaccttaagtcctgccaacaattcacactccagaaaggcagaagtgatttacagagtccaaattgtggatcccagtcaaattctggaagggatcaacctgtctaaaaggaaagagctacagtggcctgatgaaggaatccggttaaaagctgggagaaatagctggaaagactggagtccgcaggagggcatggaaggccatgtgattcaccgatgggtgccttgcagcagagatccaggtaccagatcccacatcgacaaggcagtgcttctggtccagattgatgataaatatgtgactgtaattgaaactggggtactagaacttggggctgaagtgtgagccagtgtttattataaagacatttctttttccctctcaattccaaggcattggaaaaagagaggaacaagcagaagatgcctgcaggtatcacttt

SEQ ID NO: 12 - protein, 1446 aa, Homo sapiens
MSLVNFEPAARRASNIWDTDSHVSSSTSVRFYPHDVIRLNRLLTIDTDLLEQQDIDLSPDLAATYGPTEEAAQKVKHYYRFWILPQLWIGINFDRLTLLALFDRNREILENVLAVILAILVAFLGSILLIQGFFRDIWVFQFCLVIASCQYSLLKSVQPDSSSPRHGHNRIIAYSRPVYFCICCGLIWLLDYGSRNLTATKFKLYGITFTNPLVFISARDLVIVFTLCFPIVFFIGLLPQVNTFVMYLCEQLDIHIFGGNATTSLLAALYSFICSIVAVALLYGLCYGALQDSWDGQHIPVLFSIFCGLLVAVSYHLSRQSSDPSVLSSLVQSKIFPKTEEKNPEDPLSEVKDPLPEKLRNSVSERLQSDLVVCIVIGVLYFAIHVSTVFTVLQPALKYVLYTLVGFVGFVTHYVLPQVRKQLPWHCFSHPLLKTLEYNQYEVRDAATMMWFEKLHVWLLFVEKNIIYPLIVLNELSSSAETIASPKKLNTELGALMITVAGLKLLRSSFSSPTYQYVTVIFTVLFFKFDYEAFSETMLLDLFFMSILFNKLWELLYKLQFVYTYIAPWQITWGSAFHAFAQPFAVPRSAMLFIQAAVSAFFSTPLNPFLGSAIFITSYVRPVKFWERDYSTKRVDHSNTRLASQLDRNPGSDDNNLNSIFYEHLTRSLQHSLCGDLLLGRWGNYSTGDCFILASDYLNALVHLIEIGNGLVTFQLRGLEFRGTYCQQREVEAITEGVEEDEGFCCCEPGHIPHMLSFNAAFSQRWLAWEVIVTKYILEGYSITDNSAASMLQVFDLRKVLTTYYVKGIIYYVTTSSKLEEWLANETMQEGLRLCADRNYVDVDPTFNPNIDEDYDHRLAGISRESFCVIYLNWIEYCSSRRAKPVDVDKDSSLVTLCYGLCVLGRRALGTASHHMSSNLESFLYGLHALFKGDFRISSIRDEWIFADMELLRKVVVPGIRMSIKLHQDHFTSPDEYDDPTVLYEAIVSHEKNLVIAHEGDPAWRSAVLANSPSLLALRHVMDDGTNEYKIIMLNRRYLSFRVIKVNKECVRGLWAGQQQELVFLRNRNPERGSIQNAKQALRNMINSSCDQPIGYPIFVSPLTTSYSDSHEQLKDILGGPISLGNIRNFIVSTWHRLRKGCGAGCNSGGNIEDSDTGGGTSCTGNNATTANNPHSNVTQGSIGNPGQGSGTGLHPPVTSYPPTLGTSHSSHSVQSGLVRQSPARASVASQSSYCYSSRHSSLRMSTTGFVPCRRSSTSQISLRNLPSSIQSRLSMVNQMEPSGQSGLACVQHGLPSSSSSSQSIPACKHHTLVGFLATEGGQSSATDAQPGNTLSPANNSHSRKAEVIYRVQIVDPSQILEGINLSKRKELQWPDEGIRLKAGRNSWKDWSPQEGMEGHVIHRWVPCSRDPGTRSHIDKAVLLVQIDDKYVTVIETGVLELGAEV

SEQ ID NO: 13 - DNA, 1500 bp, Homo sapiens
  CDS (182)..(1390)
tcatcttaaatttttttagctgatatagttgtaatttcttaacctagctcatctctagaggatatgtaaaaacataaaacacctcaattacttgtgaattatagaggtgtatcagttggtttaaaagtgcttttattgggctgagctcttggaagactcaggtccttgggtcataggcatcatggaccaatctgaagaaaactgcatttcagggcctgttgaggctaaaactccagttggaggtccagaacatgttctcgtgactcagcaatttccttgtcagaatccattacctgcaaatagtggccaggctcagtgggtcttgtgtccttcaaattcttcgcagcgtgttcctttgcaagcacaaaagcttgtctccagtcacaagccagttcagaatcagaagcagaagcaattgcaggcaaccagtgtacctcatcctgcctccaggccactgaataacacccaaaacagcaagcagtccccgctgtcggcacctgaaaataatcctgaggaggaactggcatcaaaacagaaaaatgaagaatcaaaaaagaggcaatgggctttggaagaccttgaaattggtcgccctccgggtaaaggaaagtttggtaatgtttatttggcaagagaaaaacaaagcaagtttattctggctcttagggtgttatttaaagctcagctggagaaagcaggagtggagcatcaactcagaagagaagtagaaatacagtcccacctccaacatcctaatataatcagactgtatggttatttccatgatgccaccagagtctacctaattctggaatatacaccacttgaaacagtcaatacagaacttcagaaactttcaaagtttgatgagcagagaactgctacttatatcacagaattggcaagtgccctgtcttactgtcattcaaaaacagttattcatagagacattaagccagagaacttacttcttggatcagctggagagcttgaaattgcaaattttgggtggtcagaacatgctccatcttccaggaggaccactctctgtggcaccctggactacctgccccccgaaatgattgaaggtcggatgcatgatgagaaggtggatctctggagccttggagttctttgctgtgaatttttagttgggaagcctccttttgaggcaaatacataccaagagacctacaaaagaatatcacgggttgagttcacattccctgactttgtaacagagggagccagggacctcatttcaagactgttgaagcatgttcccagccagaggccaatgctcagagaagtacttgaatacccctggatcacagcaaattcatcaaaaccatcaaattgccaaaacaaagaatcaactagcaagtattcttaggaatcgtgcagggggagaaatccttgagccagggctgctgtataacctctcaggaacatgctaccaaaatttattttaccattgactgctgccctcaatctagaaca

SEQ ID NO: 14 - protein, 403 aa, Homo sapiens
MDQSEENCISGPVEAKTPVGGPEHVLVTQQFPCQNPLPANSGQAQWVLCPSNSSQRVPLQAQKLVSSHKPVQNQKQKQLQATSVPHPASRPLNNTQNSKQSPLSAPENNPEEELASKQKNEESKKRQWALEDLEIGRPPGKGKFGNVYLAREKQSKFILALRVLFKAQLEKAGVEHQLRREVEIQSHLQHPNIIRLYGYFHDATRVYLILEYTPLETVNTELQKLSKFDEQRTATYITELASALSYCHSKTVIHRDIKPENLLLGSAGELEIANFGWSEHAPSSRRTTLCGTLDYLPPEMIEGRMHDEKVDLWSLGVLCCEFLVGKPPFEANTYQETYKRISRVEFTFPDFVTEGARDLISRLLKHVPSQRPMLREVLEYPWITANSSKPSNCQNKESTSKYS

SEQ ID NO: 15 - DNA, 1500 bp, Homo sapiens
  CDS (101)..(1426)
gtatccccaagagaaaatacgcatcaaaaattaggaacttagaaatgatagttgaggtggaggaacttccagcagtggcagctcaagtggccaagacaagatgggtcaaagtcagggtgatggtcatggtcctagacgtggcaagaaggatgaaaaggacaagaaaaataagtacgaacctcttgtaccaactagagtggcggaaaaagaagaaaaaacaaagggacaagatgttgccagtaaactgccactggtgacacttcacactcagtgtcggttaaaattactgaagttagagagaattaaagactaccttctcatggtggaagaattcattagaaatcaggaacaaataaaactattagaagaaaagcaagaggagggaagatcaaaagtggatgatctgagggggaccccaatgtcagtaggaaacttggaagagatcatcgatgacaatcatgccattgtgtctacatctgtgggctcagaacactatgacagcattatttcatttgtagagaaggatctgctggaacctggctgctcgattctgctcagacacaaggtacatgcggtgataggggtgctgatggatgatacgggtcccctggtcacaatgatgaaggtggagaaggccccccaggagacctatgtcaatactggggggttggacaaccaaattcaggaaattaaggaatctatggagcttcctctcccccatcctgaatattatgaagagatgggtacaaagcctcctaaaggggtcattctctgtggtccacctggcacaggtaaaaccttgttagccaaagcagtagcaaaccaaacctcagccactttcttgagagtggttggctctgaacttattcagaagtacctaggtgatgggcccaaactcgtacggcaagtatttcaagttgctgaagaacatgcaccatccatcatgtttactgatgaaattgaagccattgggacaaaaagatatgactccaattctggtggtgagagagaaattcagcaaacaatgttggaattggaactgttgaaccaattgggtggatttgattctagggaagatgtgaaagttatcatggccacaaaacaagtagaaactttggatccagtacttatcagaccaggccgcattgacaagaagatcgagttccacctgcctgatgaaaagactaagaagcacatctttcagattcacacaagcaggatgacactggccaatgatgtaaccctggacgacttgatcatggctaaagatgacttctctggtgctgacatcaaggcaatctgtacagaagctggtctgatggccttaagagaacatagaatgaaagcaacaaatgaagacttcaaaaaatctatagaaagtgttctttataagaaacacgaaggcatccctgaggggctttatctctagtgaaccaccgctgccatcaggaagatggttgggagatttcccaacccctgaaagggatgaggttgggggag

SEQ ID NO: 16 - protein, 442 aa, Homo sapiens [sequence omitted]

SEQ ID NO: 17 - DNA, 834 bp, Homo sapiens
  CDS (2)..(817)
catgtcctcgaccgagagcgccggccgcacggcggacaagtcgccgcgccagcaggtggaccgcctactcgtggggctgcgctggcggcggctggaggagccgctgggcttcatcaaagttctccagtggctctttgctattttcgccttcgggtcctgtggctcctacagcggggagacaggagcaatggttcgctgcaacaacgaagccaaggacgtgagctccatcatcgttgcatttggctatcccttcaggttgcaccggatccaatatgagatgcccctctgcgatgaagagtccagctccaagaccatgcacctcatgggggacttctctgcacccgccgagttcttcgtgacccttggcatcttttccttcttctataccatggctgccctagttatctacctgcgcttccacaacctctacacagagaacaaacgcttcccgctggtggacttctgtgtgactgtctccttcaccttcttctggctggtagctgcagctgcctggggcaagggcctgaccgatgtcaagggggccacacgaccatccagcttgacagcagccatgtcagtgtgccatggagaggaagcagtgtgcagtgccggggccacgccctctatgggcctggccaacatctccgtgctctttggctttatcaacttcttcctgtgggccgggaactgttggtttgtgttcaaggagaccccgtggcatggacagggccagggccaggaccaggaccaggaccaggaccagggccagggtcccagccaggagagtgcagctgagcagggagcagtggagaagcagtaagcagccccccacct

SEQ ID NO: 18 - protein, 272 aa, Homo sapiens
MSSTESAGRTADKSPRQQVDRLLVGLRWRRLEEPLGFIKVLQWLFAIFAFGSCGSYSGETGAMVRCNNEAKDVSSIIVAFGYPFRLHRIQYEMPLCDEESSSKTMHLMGDFSAPAEFFVTLGIFSFFYTMAALVIYLRFHNLYTENKRFPLVDFCVTVSFTFFWLVAAAAWGKGLTDVKGATRPSSLTAAMSVCHGEEAVCSAGATPSMGLANISVLFGFINFFLWAGNCWFVFKETPWHGQGQGQDQDQDQDQGQGPSQESAAEQGAVEKQ

SEQ ID NO: 19 - DNA, 1020 bp, Homo sapiens
  CDS (2)..(994)
cctgaccgggcgggaagtcctgacgcccttcccaggattgggcactgcggcagccccggcacagggcggggcccacctgaagcagtgtgacctgctgaagctgtcccggcggcagaagcagctctgccggagggagcccggcctggctgagaccctgagggatgctgcgcacctcggcctgcttgagtgccagtttcagttccggcatgagcgctggaactgtagcctggagggcaggatgggcctgctcaagagaggcttcaaagagacagctttcctgtacgcggtgtcctctgccgccctcacccacaccctggcccgggcctgcagcgctgggcgcatggagcgctgcacctgtgatgactctccggggctggagagccggcaggcctggcagtggggcgtgtgcggtgacaacctcaagtacagcaccaagtttctgagcaacttcctggggtccaagagaggaaacaaggacctgcgggcacgggcagacgcccacaatacccacgtgggcatcaaggctgtgaagagtggcctcaggaccacgtgtaagtgccatggcgtatcaggctcctgtgccgtgcgcacctgctggaagcagctctccccgttccgtgagacgggccaggtgctgaaactgcgctatgactcggctgtcaaggtgtccagtgccaccaatgaggccttgggccgcctagagctgtgggcccctgccaggcagggcagcctcaccaaaggcctggccccaaggtctggggacctggtgtacatggaggactcacccagcttctgccggcccagcaagtactcacctggcacagcaggtagggtgtgctcccgggaggccagctgcagcagcctgtgctgcgggcggggctatgacacccagagccgcctggtggccttctcctgccactgccaggtgcagtggtgctgctacgtggagtgccagcaatgtgtgcaggaggagcttgtgtacacctgcaagcactaggcctactgcccagcaagccagtc

SEQ ID NO: 20 - protein, 331 aa, Homo sapiens
LTGREVLTPFPGLGTAAAPAQGGAHLKQCDLLKLSRRQKQLCRREPGLAETLRDAAHLGLLECQFQFRHERWNCSLEGRMGLLKRGFKETAFLYAVSSAALTHTLARACSAGRMERCTCDDSPGLESRQAWQWGVCGDNLKYSTKFLSNFLGSKRGNKDLRARADAHNTHVGIKAVKSGLRTTCKCHGVSGSCAVRTCWKQLSPFRETGQVLKLRYDSAVKVSSATNEALGRLELWAPARQGSLTKGLAPRSGDLVYMEDSPSFCRPSKYSPGTAGRVCSREASCSSLCCGRGYDTQSRLVAFSCHCQVQWCCYVECQQCVQEELVYTCKH

SEQ ID NO: 21 - DNA, 1085 bp, Homo sapiens
  CDS (13)..(1077)
tagtgagccgagatggcactactatattccagcttgggtgtggttgtgtgcacctgtagtcctagttactttggactgacgggcagcgagcccctgaccatcctcccgctgaccctggagccagaggcggctgcccaggcgcactacaaggcctgcgaccggctgaagctggagcggaagcagcggcgcatgtgccgccgggacccgggcgtggcagagacgctggtggaggccgtgagcatgagtgcgctcgagtgccagttccagttccgctttgagcgctggaactgcacgctggagggccgctaccgggccagcctgctcaagcgaggtttcaaggagactgccttcctctatgccatctcctcggctggcctgacgcacgcactggccaaggcgtgcagcgcgggccgcatggagcgctgtacctgcgatgaggcacccgacctggagaaccgtgagggctggaagtggggtggctgtagcgaggacatcgagtttggtgggatggtgtctcgggagttcgccgacgcccgggagaaccggccagatgcccgctcagccatgaaccgccacaacaacgaggctgggcgccaggtgatcaaggctggggtggagaccacctgcaagtgccacggcgtgtcaggctcatgcacggtgcggacctgctggcggcagttggcgcctttccatgaggtgggcaagcatctgaagcacaagtatgagtcggcactcaaggtgggcagcaccaccaatgaagctgccggcgaggcaggtgccatctccccaccacggggccgtgcctcgggggcaggtggcagcgacccgctgccccgcactccagagctggtgcacctggatgactcgcctagcttctgcctggctggccgcttctccccgggcaccgctggccgtaggtgccaccgtgagaagaactgcgagagcatctgctgtggccgcggccataacacacagagccgggtggtgacaaggccctgccagtgccaggtgcgttggtgctgctatgtggagtgcaggcagtgcacgcagcgtgaggaggtctacacctgcaagggctgagttcc

SEQ ID NO: 22 - protein, 355 aa, Homo sapiens
MALLYSSLGVVVCTCSPSYFGLTGSEPLTILPLTLEPEAAAQAHYKACDRLKLERKQRRMCRRDPGVAETLVEAVSMSALECQFQFRFERWNCTLEGRYRASLLKRGFKETAFLYAISSAGLTHALAKACSAGRMERCTCDEAPDLENREGWKWGGCSEDIEFGGMVSREFADARENRPDARSAMNRHNNEAGRQVIKAGVETTCKCHGVSGSCTVRTCWRQLAPFHEVGKHLKHKYESALKVGSTTNEAAGEAGAISPPRGRASGAGGSDPLPRTPELVHLDDSPSFCLAGRFSPGTAGRRCHREKNCESICCGRGHNTQSRVVTRPCQCQVRWCCYVECRQCTQREEVYTCKG

SEQ ID NO: 23 - DNA, 2037 bp, Homo sapiens
  CDS (16)..(2019)
gccgccgccgccaagatggcggacctggaggcggtgctggccgacgtgagctacctgatggccatggagaagagcaaggccacgccggccgcgcgcgccagcaagaagatactgctgcccgagcccagcatccgcagtgtcatgcagaagtacctggaggaccggggcgaggtgacctttgagaagatcttttcccagaagctggggtacctgctcttccgagacttctgcctgaaccacctggaggaggccaggcccttggtggaattctatgaggagatcaagaagtacgagaagctggagacggaggaggagcgtgtggcccgcagccgggagatcttcgactcatacatcatgaaggagctgctggcctgctcgcatcccttctcgaagagtgccactgagcatgtccaaggccacctggggaagaagcaggtgcctccggatctcttccagccatacatcgaagagatttgtcaaaacctccgaggggacgtgttccagaaattcattgagagcgataagttcacacggttttgccagtggaagaatgtggagctcaacatccacctgaccatgaatgacttcagcgtgcatcgcatcattgggcgcgggggctttggcgaggtctatgggtgccggaaggctgacacaggcaagatgtacgccatgaagtgcctggacaaaaagcgcatcaagatgaagcagggggagaccctggccctgaacgagcgcatcatgctctcgctcgtcagcactggggactgcccattcattgtctgcatgtcatacgcgttccacacgccagacaagctcagcttcatcctggacctcatgaacggtggggacctgcactaccacctctcccagcacggggtcttctcagaggctgacatgcgcttctatgcggccgagatcatcctgggcctggagcacatgcacaaccgcttcgtggtctaccgggacctgaagccagccaacatccttctggacgagcatggccacgtgcggatctcggacctgggcctggcctgtgacttctccaagaagaagccccatgccagcgtgggcacccacgggtacatggctccggaggtcctgcagaagggcgtggcctacgacagcagtgccgactggttctctctggggtgcatgctcttcaagttgctgcgggggcacagccccttccggcagcacaagaccaaagacaagcatgagatcgaccgcatgacgctgacgatggccgtggagctgcccgactccttctcccctgaactacgctccctgctggaggggttgctgcagagggatgtcaaccggagattgggctgcctgggccgaggggctcaggaggtgaaagagagcccctttttccgctccctggactggcagatggtcttcttgcagaagtaccctcccccgctgatccccccacgaggggaggtgaacgcggccgacgccttcgacattggctccttcgatgaggaggacacaaaaggaatcaagcaggaggtggcagagactgtcttcgacaccatcaacgctgagacagaccggctggaggctcgcaagaaagccaagaacaagcagctgggccatgaggaagactacgccctgggcaaggactgcatcatgcatggctacatgtccaagatgggcaaccccttcctgacccagtggcagcggcggtacttctacctgttccccaaccgcctcgagtggcggggcgagggcgaggccccgcagagcctgctgaccatggaggagatccagtcggtggaggagacgcagatcaaggagcgcaagtgcctgctcctcaagatccgcggtgggaaacagttcattttgcagtgcgatagcgaccctgagctggtgcagtggaagaaggagctgcgcgacgcctaccgcgaggcccagcagctggtgcagcgggtgcccaagatgaagaacaagccgcgctcgcccgtggtggagctgagcaaggtgccgctggtccagcgcggcagtgccaacggcctctgacccgcccacccgcct

SEQ ID NO: 24 - protein, 668 aa, Homo sapiens
MADLEAVLADVSYLMAMEKSKATPAARASKKILLPEPSIRSVMQKYLEDRGEVTFEKIFSQKLGYLLFRDFCLNHLEEARPLVEFYEEIKKYEKLETEEERVARSREIFDSYIMKELLACSHPFSKSATEHVQGHLGKKQVPPDLFQPYIEEICQNLRGDVFQKFIESDKFTRFCQWKNVELNIHLTMNDFSVHRIIGRGGFGEVYGCRKADTGKMYAMKCLDKKRIKMKQGETLALNERIMLSLVSTGDCPFIVCMSYAFHTPDKLSFILDLMNGGDLHYHLSQHGVFSEADMRFYAAEIILGLEHMHNRFVVYRDLKPANILLDEHGHVRISDLGLACDFSKKKPHASVGTHGYMAPEVLQKGVAYDSSADWFSLGCMLFKLLRGHSPFRQHKTKDKHEIDRMTLTMAVELPDSFSPELRSLLEGLLQRDVNRRLGCLGRGAQEVKESPFFRSLDWQMVFLQKYPPPLIPPRGEVNAADAFDIGSFDEEDTKGIKQEVAETVFDTINAETDRLEARKKAKNKQLGHEEDYALGKDCIMHGYMSKMGNPFLTQWQRRYFYLFPNRLEWRGEGEAPQSLLTMEEIQSVEETQIKERKCLLLKIRGGKQFILQCDSDPELVQWKKELRDAYREAQQLVQRVPKMKNKPRSPVVELSKVPLVQRGSANGL

SEQ ID NO: 25 - DNA, 3003 bp, Homo sapiens
  CDS (57)..(2945)
ggtatcatactccagcaagcgcacatcatcagtgacgtcgatcacgatgcatcgtcatggcggcagcgccgttcttgaagcactggcgcaccacttttgagcgggtggagaagttcgtgtccccgatctacttcaccgactgtaacctccgcggcaggctttttggggccagctgccctgtggctgtgctctccagcttcctgacgccggagagacttccctaccaggaggcagtccagcgggacttccgccccgcgcaggtcggcgacagcttcggacccacatggtggacctgctggttccgggtggagctgaccatcccagaggcatgggtgggccaggaagttcacctttgctgggaaagtgatggagaaggtctggtgtggcgtgatggagaacctgtccagggtttaaccaaagagggtgagaagaccagctatgtcctgactgacaggctgggggaaagagacccccgaagcctcactctctatgtggaagtagcctgcaatgggctcctgggggccgggaagggaagcatgattgcagcccctgaccctgagaagatgttccagctgagccgggctgagctagctgtgttccaccgggatgtccacatgctcctggtggatctggagctgctgctgggcatagccaaggcgcagcagctggaatgggtgaagagccgctaccctggcctgtactcccgcatccaggagtttgcgtgccgtgggcagtttgtgcctgtggggggcacctgggtggagatggatgggaacctgcccagtggagaggccatggtgaggcagtttttgcagggccagaacttctttctgcaggagtttgggaagatgtgctctgagttctggctgccggacacctttggctactcagcacagctcccccagatcatgcacggctgtggcatcaggcgctttctcacccagaaattgagctggaatttggtgaactccttcccacaccatacatttttctgggagggcctggatggctcccgtgtactggtccacttcccacctggcgactcctatgggatgcagggcagcgtggaggaggtgctgaagaccgtggccaacaaccgggacaaggggcgggccaaccacagtgccttcctctttggctttggggatgggggtggtggccccacccagaccatgctggaccgcctgaagcgcctgagcaatacggatgggctgcccagggtgcagctatcttctccaagacagctcttctcagcactggagagtgactcagagcagctgtgcacgtgggttggggagctcttcttggagctgcacaatggcacatacaccacccatgcccagatcaagaaggggaaccgggaatgtgagcggatcctgcacgacgtggagctgctcagtagcctggccctggcccgcagtgcccagttcctatacccagcagcccagctgcagcacctctggaggctccttcttctgaaccagttccatgatgtggtgactggaagctgcatccagatggtggcagaggaagccatgtgccattatgaagacatccgttcccatggcaatacactgctcagcgctgcagccgcagccctgtgtgctggggagccaggtcctgagggcctcctcatcgtcaacacactgccctggaagcggatcgaagtgatggccctgcccaaaccgggcggggcccacagcctagccctggtgacagtgcccagcatgggctatgctcctgttcctccccccacctcactgcagcccctgctgccccagcagcctgtgttcgtagtgcaagagactgatggctccgtgactctggacaatggcatcatccgagtgaagctggacccaactggtcgcctgacgtccttggtcctggtggcctctggcagggaggccattgctgagggcgccgtggggaaccagtttgtgctatttgatgatgtccccttgtactgggatgcatgggacgtcatggactaccacctggagacacggaagcctgtgctgggccaggcagggaccctggcagtgggcaccgagggcggcctgcggggcagcgcctggttcttgctacagatcagccccaacagtcggcttagccaggaggttgtgctggacgttggctgcccctatgtccgcttccacaccgaggtacactggcatgaggcccacaagttcctgaaggtggagttccctgctcgcgtgcggagttcccaggccacctatgagatccagtttgggcacctgcagcgacctacccactacaatacctcttgggactgggctcgatttgaggtgtgggcccatcgctggatggatctgtcagaacacggctttgggctggccctgctcaacgactgcaagtatggcgcgtcagtgcgaggcagcatcctcagcctctcgctcttgcgggcgcctaaagccccggacgctactgctgacacggggcgccacgagttcacctatgcactgatgccgcacaagggctctttccaggatgctggcgttatccaagctgcctacagcctaaacttccccctgttggctctgccagcccccagcccagcgcccgccacctcctggagtgcgttttccgtgtcttcacccgcggtcgtattggagaccgtcaagcaggcggagagcagcccccagcgccgctcgctggtcctgaggctgtatgaggcccacggcagccacgtggactgctggctgcacttgtcgctgccggttcaggaggccatcctctgcgatctcttggagcgaccagaccctgctggccacttgacttcgggacaaccgcctgaagctcaccttttctcccttccaagtgctgtccctgttgctcgtgcttcagcctccgccacactgagtccctggggctggggttttgtttgtagaaggctctggggactcctaatttctgcttccccagcctaaagcagggatcagtcttttcttgtggaataaatccttggatcgggaaaaaaaaaaa

SEQ ID NO: 26 - protein, 963 aa, Homo sapiens
MAAAPFLKHWRTTFERVEKFVSPIYFTDCNLRGRLFGASCPVAVLSSFLTPERLPYQEAVQRDFRPAQVGDSFGPTWWTCWFRVELTIPEAWVGQEVHLCWESDGEGLVWRDGEPVQGLTKEGEKTSYVLTDRLGERDPRSLTLYVEVACNGLLGAGKGSMIAAPDPEKMFQLSRAELAVFHRDVHMLLVDLELLLGIAKAQQLEWVKSRYPGLYSRIQEFACRGQFVPVGGTWVEMDGNLPSGEAMVRQFLQGQNFFLQEFGKMCSEFWLPDTFGYSAQLPQIMHGCGIRRFLTQKLSWNLVNSFPHHTFFWEGLDGSRVLVHFPPGDSYGMQGSVEEVLKTVANNRDKGRANHSAFLFGFGDGGGGPTQTMLDRLKRLSNTDGLPRVQLSSPRQLFSALESDSEQLCTWVGELFLELHNGTYTTHAQIKKGNRECERILHDVELLSSLALARSAQFLYPAAQLQHLWRLLLLNQFHDVVTGSCIQMVAEEAMCHYEDIRSHGNTLLSAAAAALCAGEPGPEGLLIVNTLPWKRIEVMALPKPGGAHSLALVTVPSMGYAPVPPPTSLQPLLPQQPVFVVQETDGSVTLDNGIIRVKLDPTGRLTSLVLVASGREAIAEGAVGNQFVLFDDVPLYWDAWDVMDYHLETRKPVLGQAGTLAVGTEGGLRGSAWFLLQISPNSRLSQEVVLDVGCPYVRFHTEVHWHEAHKFLKVEFPARVRSSQATYEIQFGHLQRPTHYNTSWDWARFEVWAHRWMDLSEHGFGLALLNDCKYGASVRGSILSLSLLRAPKAPDATADTGRHEFTYALMPHKGSFQDAGVIQAAYSLNFPLLALPAPSPAPATSWSAFSVSSPAVVLETVKQAESSPQRRSLVLRLYEAHGSHVDCWLHLSLPVQEAILCDLLERPDPAGHLTSGQPPEAHLFSLPSAVPVARASASATLSPWGWGFVCRRLWGLLISASPA

SEQ ID NO: 27 - DNA, 805 bp, Homo sapiens
  CDS (83)..(796)
gagtgaggaagatttgctggccctggcagcgtcgcggctgagccgccgcaagagggtggcgggcgcggccgtcggagtggccatggtgctgctgctgctggtggccatcccgctgctggtgcacagctcccgcgggccagcgcactacgagatgctgggtcgctgccgcatggtgtgcgacccgcatgggccccgtggccctggtccggacggcgcgcctgcttccgtgccccccttcccgccaggcgccaagggagaggtgggccggtgcgggaaagcaggcctgagggggccccctggaccaccaggtccaagagggcccccaggagaacccggcaggccaggccccccgggccctcccggtccaggtccgggcggggtggcgcccgctgccggctacgtgcctcgcattgctttctacgcgggcctgcggcggccccacgagggttacgaggtgctgcgcttcgacgacgtggtgaccaacgtgggcaacgcctacgaggcagccagcggcaagtttacttgccccatgccaggcgtctacttcttcgcttaccacgtgctcatgcgcggcggcgacggcaccagcatgtgggccgacctcatgaagaacggacaggtccgggccagcgccattgctcaggacgcggaccagaactacgactacgccagcaacagcgtcattctgcacctggacgtgggcgacgaggtcttcatcaagctggacggcgggaaagtgcacggcggcaacaccaacaagtacagcaccttctccggcttcatcatctaccccgactgagccggc

SEQ ID NO: 28 - protein, 238 aa, Homo sapiens
MVLLLLVAIPLLVHSSRGPAHYEMLGRCRMVCDPHGPRGPGPDGAPASVPPFPPGAKGEVGRCGKAGLRGPPGPPGPRGPPGEPGRPGPPGPPGPGPGGVAPAAGYVPRIAFYAGLRRPHEGYEVLRFDDVVTNVGNAYEAASGKFTCPMPGVYFFAYHVLMRGGDGTSMWADLMKNGQVRASAIAQDADQNYDYASNSVILHLDVGDEVFIKLDGGKVHGGNTNKYSTFSGFIIYPD

SEQ ID NO: 29 - DNA, 805 bp, Homo sapiens
  CDS (83)..(796)
gagtgaggaagatttgctggccctggcagcgtcgcggctgagccgccgcaagagggtggcgggcgcggccgtcggagtggccatggtgctgctgctgctggtggccatcccgctgctggtgcacagctcccgcgggccagcgcactacgagatgctgggtcgctgccgcatggtgtgcgacccgcatgggccccgtggccctggtccggacggcgcgcctgcttccgtgccccccttcccgccaggcgccaagggagaggtgggccggcgcgggaaagcaggcctgcgggggccccctggaccaccaggtccaagagggcccccaggagaacccggcaggccaggccccccgggccctcccggtccaggtccgggcggggtggcgcccgctgccggctacgtgcctcgcattgctttctacgcgggcctgcggcggccccacgagggttacgaggtgctgcgcttcgacgacgtggtgaccaacgtgggcaacgcctacgaggcagccagcggcaagtttacttgccccatgccaggcgtctacttcttcgcttaccacgtgctcatgcgcggcggcgacggcaccagcatgtgggccgacctcatgaagaacggacaggtccgggccagcgccattgctcaggacgcggaccagaactacgactacgccagcaacagcgtcattctgcacctggacgtgggcgacgaggtcttcatcaagctggacggcgggaaagtgcacggcggcaacaccaacaagtacagcaccttctccggcttcatcatctaccccgactgagccggc

SEQ ID NO: 30 - protein, 238 aa, Homo sapiens
MVLLLLVAIPLLVHSSRGPAHYEMLGRCRMVCDPHGPRGPGPDGAPASVPPFPPGAKGEVGRRGKAGLRGPPGPPGPRGPPGEPGRPGPPGPPGPGPGGVAPAAGYVPRIAFYAGLRRPHEGYEVLRFDDVVTNVGNAYEAASGKFTCPMPGVYFFAYHVLMRGGDGTSMWADLMKNGQVRASAIAQDADQNYDYASNSVILHLDVGDEVFIKLDGGKVHGGNTNKYSTFSGFIIYPD

SEQ ID NO: 31 - DNA, 5895 bp, Homo sapiens
  CDS (23)..(5797)
cagggctgaagctcctggcaccatgatgctcaccccagcaggaccagagcaccgaggcccaaggccccagcctgccatgccgctgccaccgcggagcctgcaggtgctcctgctgctgctgctgttgctgctgctgctgccgggcatgtgggctgaggcaggcttgcccagggcaggcgggggttcacagccccccttccgcaccttctcggccagcgactggggcctcacccacctagtggtgcatgagcagacaggcgaggtgtatgtgggcgcagtgaaccgcatctataagctgtcggggaacctgacactgctgcgggcccacgtcacgggccctgtggaggacaacgagaagtgctacccgccgcccagcgtgcagtcctgcccccacggcctgggcagtactgacaacgtcaacaagctgctgctgctggactatgccgctaaccgcctgctggcctgtggcagcgcctcccagggcatctgccagttcctgcgtctggacgatctcttcaaactgggtgagccacaccaccgtaaggagcactacctgtccagcgtgcaggaggcaggcagcatggcgggcgtgctcattgccgggccaccgggccagggccaggccaagctcttcgtgggcacacccatcgatggcaagtccgagtacttccccacactgtccagccgtcggctcatggccaacgaggaggatgccgacatgttcggcttcgtgtaccaggatgagtttgtgtcatcacagctcaagatcccttcggacacgctgtccaagttcccggcctttgacatctactatgtgtacagcttccgcagcgagcagtttgtctactacctcacgctgcagctagacacacagctgacctcgcctgatgccgccggcgagcacttcttcacgtccaagatcgtgcggctctgtgtggacgaccccaaattctactcgtacgttgagttccccattggctgcgagcaggcgggtgtggagtaccgcctggtgcaggatgcctacctgagccggcccggccgtgccctggcccaccagctgggcctggctgaggacgaggacgtgctgttcactgtgttcgcccagggccagaagaaccgcgtgaagccaccaaaggagtcagcactgtgcctgttcacgctcagggccatcaaggagaagattaaggagcgcatccagtcctgctaccgtggtgagggcaagctctccctgccgtggctgctcaacaaggagctgggctgcatcaactcgcccctgcagatcgatgacgacttctgcgggcaggacttcaaccagcccctggggggcacagtcaccattgaggggacgcccctgttcgtggacaaggatgatggcctgaccgccgtggctgcctatgactatcggggccgcactgtggtattcgccggcacgcgaagtggccgcatccgcaagatcctggtggacctctcaaaccccggtggccggcctgccctggcctacgagagcgtcgtggcccaggagggcagccccatcctgcgagacctcgtcctcagccccaaccaccagtacctctacgccatgaccgagaagcaggtgacgcgggtgcctgtggagagctgtgtgcagtacacgtcctgtgagctgtgtctggggtcacgggacccccactgtggctggtgtgtcctgcacagcatgtgctcgcggcgggacgcctgtgagcgagcagacgagccccagcgctttgctgcggacctgctgcagtgtgtgcagctgactgtgcagccccgcaatgtgtctgtcaccatgtcccaggtcccagtacttgtgctgcaggcctggaacgtgcctgacctctcagctggcgtcaactgctccttcgaggacttcacggaatctgagagcgtcctggaggatggccggatccactgccgctcaccctccgcccgggaggtggcgcccatcacgcggggccagggtgagggagaccagcgggtggtgaaactctacctaaagtccaaggagacagggaagaagtttgcgtctgtggacttcgtcttctacaactgcagcgtccaccagtcgagctgcctgtcctgtgtcaacggctcctttccctgccactggtgcaaataccgccacgtgtgcacacacaacgtggctgactgcgccttcctggagggccgtgtcaacgtgtctgaggactgcccacagatcctgccctccacgcagatctacgtgccagtgggagtggtaaaacccatcaccctggccgcacggaacctgccacagccacagtcaggccagcgtggatatgagtgcctcttccacatcccgggcagcccggcccgtgtcaccgccctgcgcttcaacagctccagcctgcagtgccagaattcctcgtactcctacgaggggaacgatgtcagcgacctgccagtgaacctgtcagtcgtgtggaacggcaactttgtcattgacaacccacagaacatccaggcgcacctctacaagtgcccggccctgcgcgagagctgcggcctctgcctcaaggccgacccgcgcttcgagtgcggatggtgcgtggccgagcgccgctgctccctgcgacaccactgcgctgccgacacacctgcatcgtggatgcacgcgcgtcacggcagcagtcgctgcaccgaccccaagatcctcaagctgtcccccgagacgggcccgaggcagggcggcacgcggctcactatcacaggcgagaacctgggcctgcgattcgaagacgtgcgtctgggcgtgcgcgtgggcaaggtgctgtgcagccctgtggagagcgagtacatcagtgcggagcagatcgtctgtgagatcggggacgccagctccgtgcgtgcccatgacgccctggtggaggtgtgtgtgcgggactgctcaccacactaccgcgccctgtcacccaagcgcttcaccttcgtgacaccaaccttctaccgtgtgagcccctcccgtgggcctctgtcagggggcacctggattggcatcgagggaagccacctgaacgcaggcagtgatgtggctgtgtcggtcggtggccggccctgctccttctcctggtccaggaggaactcccgtgagatccggtgcctgacaccccccgggcagagccctggcagcgctcccatcatcatcaacatcaaccgcgcccagctcaccaaccctgaggtgaagtacaactacaccgaggaccccaccatcctgaggatcgaccccgagtggagcatcaacagcggtgggaccctcctgacggtcacaggcaccaacctggccactgtccgtgaaccccgaatccgggccaagtatggaggcattgagagggagaactgcctggtgtacaatgacaccaccatggtatgccgcgccccgtctgtggccaaccctgtgcgcagcccaccagagctgggggagcggccggatgagctgggcttcgtcatggacaacgtgcgctccctgcttgtgctcaactccacctccttcctctactaccctgaccccgtactggagccactcagccccactggcctgctggagctgaagcccagctccccactcatcctcaagggccggaacctcttgccacctgcacccggcaactcccgactcaactacacggtgctcatcggctccacaccctgtaccctcaccgtgtcggagacgcaactgctgtgcgaggcgcccaacctcactgggcagcacaaggtcacggtgcgtgcaggtggcttcgagttctcgccagggacactgcaggtgtactcggacagcctgctgacgctgcctgccattgtgggcattggcggaggcgggggtctcctgctgctggtcatcgtggctgtgctcatcgcctacaagcgcaagtcacgagatgctgaccgcacactcaagcggctgcagctccagatggacaacctggagtcccgcgtggccctcgaatgcaaggaagcctttgcagagctgcagacagacatccacgagctgaccaatgacctggacggtgccggcatccccttccttgactaccggacatatgccatgcgggtgctctttcctgggatcgaggaccaccctgtgctcaaggagatggaggtacaggccaatgtggagaagtcgctgacactgttcgggcagctgctgaccaagaagcacttcctgctgaccttcatccgcacgctggaggcacagcgcagcttctccatgcgcgaccgcgggaatgtggcctcgctcatcatgacggccctgcagggcgagatggaatacgccacaggcgtgctcaagcagctgctttccgacctcatcgagaagaacctggagagcaagaaccaccccaagctgctactgcgccggccaactgagtcggtggcagagaagatgctaactaactggttcaccttcctcttgtataagttcctcaaggagtgcgctggggagccgctgttcatgctgtactgcgccatcaagcagcagatggagaagggccccattgacgccatcacgggtgaggcacgctactccctgagtgaggacaagctcatccggcagcagattgactacaagacactgaccctgaactgtgtgaaccctgagaatgagaatgcacctgaggtgccggtgaaggggctggactgtgacacggtcacccaggccaaggagaagctgctggacgctgcctacaagggcgtgccctactcccagcggcccaaggccgcggacatggacctggagtggcgccagggccgcatggcgcgcatcatcctgcaggacgaggacgtcaccaccaagattgacaacgattggaagaggctgaacacactggctcactaccaggtgacagacgggtcctcggtggcactggtgcccaagcagacgtccgcctacaacatctccaactcctccaccttcaccaagtccctcagcagatacgagagcatgctgcgcacggccagcagccccgacagcctgcgctcgcgcacgcccatgatcacgcccgacctggagagcggcaccaagctgtggcacctggtgaagaaccacgaccacctggaccagcgtgagggtgaccgcggcagcaagatggtctcggagatctacttgacacggctactggccaccaagcagggcacactgcagaagtttgtggacgacctgtttgagaccatcttcagcacggcacaccggggctcagccctgccgctggccatcaagtacatgttcgacttcctggatgagcaggccgacaagcaccagatccacgatgctgacgtgcgccacacctggaagagcaactgcagcctgcccctgcgcttctgggtgaacgtgatcaagaacccacagtttgtgttcgacattcacaagaacagcatcacggacgcctgcttgtcggtggtggcccagaccttcatggactcctgctccacctctgagcacaagctgggcaaggactcaccctccaacaagctgctctacgccaaggacatccccaactacaagagctgggtggagaggaggtactatgcagacatcgccaagatgccagccatcagcgaccaggacatgagtgcgtatctggctgagcagtcccgcctgcacctgagccagttcaacagcatgagcgccttgcacgagatctactcctacatcaccaagtacaaggatgaggtgcagatcctggcagccctggagaaggatgagcaggcgcggcggcagcggctgcggagcaagctggagcaggtggtggacacgatggccctgagcagctgagccccagctgtgatcatccagcatgatgcagcgtgaggacagctgagcagggaccgggacagccctcaccgcatgcgtgtggagtgtccggtggt

SEQ ID NO: 32 - protein, 1925 aa, Homo sapiens
MMLTPAGPEHRGPRPQPAMPLPPRSLQVLLLLLLLLLLLPGMWAEAGLPRAGGGSQPPFRTFSASDWGLTHLVVHEQTGEVYVGAVNRIYKLSGNLTLLRAHVTGPVEDNEKCYPPPSVQSCPHGLGSTDNVNKLLLLDYAANRLLACGSASQGICQFLRLDDLFKLGEPHHRKEHYLSSVQEAGSMAGVLIAGPPGQGQAKLFVGTPIDGKSEYFPTLSSRRLMANEEDADMFGFVYQDEFVSSQLKIPSDTLSKFPAFDIYYVYSFRSEQFVYYLTLQLDTQLTSPDAAGEHFFTSKIVRLCVDDPKFYSYVEFPIGCEQAGVEYRLVQDAYLSRPGRALAHQLGLAEDEDVLFTVFAQGQKNRVKPPKESALCLFTLRAIKEKIKERIQSCYRGEGKLSLPWLLNKELGCINSPLQIDDDFCGQDFNQPLGGTVTIEGTPLFVDKDDGLTAVAAYDYRGRTVVFAGTRSGRIRKILVDLSNPGGRPALAYESVVAQEGSPILRDLVLSPNHQYLYAMTEKQVTRVPVESCVQYTSCELCLGSRDPHCGWCVLHSMCSRRDACERADEPQRFAADLLQCVQLTVQPRNVSVTMSQVPVLVLQAWNVPDLSAGVNCSFEDFTESESVLEDGRIHCRSPSAREVAPITRGQGEGDQRVVKLYLKSKETGKKFASVDFVFYNCSVHQSSCLSCVNGSFPCHWCKYRHVCTHNVADCAFLEGRVNVSEDCPQILPSTQIYVPVGVVKPITLAARNLPQPQSGQRGYECLFHIPGSPARVTALRFNSSSLQCQNSSYSYEGNDVSDLPVNLSVVWNGNFVIDNPQNIQAHLYKCPALRESCGLCLKADPRFECGWCVAERRCSLRHHCAADTPASWMHARHGSSRCTDPKILKLSPETGPRQGGTRLTITGENLGLRFEDVRLGVRVGKVLCSPVESEYISAEQIVCEIGDASSVRAHDALVEVCVRDCSPHYRALSPKRFTFVTPTFYRVSPSRGPLSGGTWIGIEGSHLNAGSDVAVSVGGRPCSFSWSRRNSREIRCLTPPGQSPGSAPIIININRAQLTNPEVKYNYTEDPTILRIDPEWSINSGGTLLTVTGTNLATVREPRIRAKYGGIERENCLVYNDTTMVCRAPSVANPVRSPPELGERPDELGFVMDNVRSLLVLNSTSFLYYPDPVLEPLSPTGLLELKPSSPLILKGRNLLPPAPGNSRLNYTVLIGSTPCTLTVSETQLLCEAPNLTGQHKVTVRAGGFEFSPGTLQVYSDSLLTLPAIVGIGGGGGLLLLVIVAVLIAYKRKSRDADRTLKRLQLQMDNLESRVALECKEAFAELQTDIHELTNDLDGAGIPFLDYRTYAMRVLFPGIEDHPVLKEMEVQANVEKSLTLFGQLLTKKHFLLTFIRTLEAQRSFSMRDRGNVASLIMTALQGEMEYATGVLKQLLSDLIEKNLESKNHPKLLLRRPTESVAEKMLTNWFTFLLYKFLKECAGEPLFMLYCAIKQQMEKGPIDAITGEARYSLSEDKLIRQQIDYKTLTLNCVNPENENAPEVPVKGLDCDTVTQAKEKLLDAAYKGVPYSQRPKAADMDLEWRQGRMARIILQDEDVTTKIDNDWKRLNTLAHYQVTDGSSVALVPKQTSAYNISNSSTFTKSLSRYESMLRTASSPDSLRSRTPMITPDLESGTKLWHLVKNHDHLDQREGDRGSKMVSEIYLTRLLATKQGTLQKFVDDLFETIFSTAHRGSALPLAIKYMFDFLDEQADKHQIHDADVRHTWKSNCSLPLRFWVNVIKNPQFVFDIHKNSITDACLSVVAQTFMDSCSTSEHKLGKDSPSNKLLYAKDIPNYKSWVERRYYADIAKMPAISDQDMSAYLAEQSRLHLSQFNSMSALHEIYSYITKYKDEVQILAALEKDEQARRQRLRSKLEQVVDTMALSS

SEQ ID NO: 33 - protein, 945 aa, Mus musculus
MRARSGVRSALLLALLLCWDPTPSLAGVDSAGQVLPDSYPSAPAEQLPYFLLEPQDAYIVKNKPVELHCRAFPATQIYFKCNGEWVSQNDHVTQESLDEATGLRVREVQIEVSRQQVEELFGLEDYWCQCVAWSSSGTTKSRRAYIRIAYLRKNFDQEPLAKEVPLDHEVLLQCRPPEGVPVAEVEWLKNEDVIDPAQDTNFLLTIDHNLIIRQARLSDTANYTCVAKNIVAKRRSTAATVIVYVNGGWSSWAEWSPCSNRCGRGWQKRTRTCTNPAPLNGGAFCEGQAFQKTACTTVCPVDGAWTEWSKWSACSTECAHWRSRECMAPPPQNGGRDCSGTLLDSKNCTDGLCVLNQRTLNDPKSHPLETSGDVALYAGLVVAVFVVVAVLMAEGVIVYRRNCRDFDTDITDSSAALTGGFHPVNFKTARPNNPQLLHPSAPPDLTASAGIYRGPVYALQDSADKIPMTNSPLLDPLPSLKIKVYNSSTIGSGSGLADGADLLGVLPPGTYPGDFSRDTHFLHLRSASLGSQHLLGLPRDPSSSVSGTFGCLGGRLSLPGTGVSLLVPNGAIPQGKFYDLYLHINKAESTLPLSEGSQTVLSPSVTCGPTGLLLCRPVVLTVPHCAEVIAGDWIFQLKTQAHQGHWEEVVTLDEETLNTPCYCQLEAKSCHILLDQLGSYVFMGESYSRSAVKRLQLAIFAPALCTSLEYSLRVYCLEDTPVALKEVLELERTLGGYLVEEPKPLLFKDSYHNLRLSLHDIPHAHWRSKLLAKYQEIPFYHVWNGSQRALHCTFTLERHSLASTEFTCKVCVRQVEGEGQIFQLHTTLAETPAGSLDALCSAPGNAITTQLGPYAFKIPLSIRQKICSSLDAPDSRGNDWRLLAQKLSMDRYLNYFATKASPTGVILDLWEARQQDDGDLNSLASALEEMGKSEMLVAMATDGDC

SEQ ID NO: 34 - protein, 945 aa, Rattus norvegicus
MRARSGARGALLLALLLCWDPTPSLAGIDSGGQALPDSFPSAPAEQLPHFLLEPEDAYIVKNKPVELHCRAFPATQIYFKCNGEWVSQKGHVTQESLDEATGLRIREVQIEVSRQQVEELFGLEDYWCQCVAWSSSGTTKSRRAYIRIAYLRKNFDQEPLAKEVPLDHEVLLQCRPPEGVPVAEVEWLKNEDVIDPAQDTNFLLTIDHNLIIRQARLSDTANYTCVAKNIVAKRRSTTATVIVYVNGGWSSWAEWSPCSNRCGRGWQKRTRTCTNPAPLNGGAFCEGQACQKTACTTVCPVDGAWTEWSKWSACSTECAHWRSRECMAPPPQNGGRDCSGTLLDSKNCTDGLCVLNQRTLNDPKSRPLEPSGDVALYAGLVVAVFVVLAVLMAVGVIVYRRNCRDFDTDITDSSAALTGGFHPVNFKTARPSNPQLLHPSAPPDLTASAGIYRGPVYALQDSADKIPMTNSPLLDPLPSLKIKVYDSSTIGSGAGLADGADLLGVLPPGTYPGDFSRDTHFLHLRSASLGSQHLLGLPRDPSSSVSGTFGCLGGRLTIPGTGVSLLVPNGAIPQGKFYDLYLRINKTESTLPLSEGSQTVLSPSVTCGPTGLLLCRPVVLTVPHCAEVIAGDWIFQLKTQAHQGHWEEVVTLDEETLNTPCYCQLEAKSCHILLDQLGTYVFTGESYSRSAVKRLQLAIFAPALCTSLEYSLRVYCLEDTPAALKEVLELERTLGGYLVEEPKTLLFKDSYHNLRLSLHDIPHAHWRSKLLAKYQEIPFYHVWNGSQKALHCTFTLERHSLASTEFTCKVCVRQVEGEGQIFQLHTTLAETPAGSLDALCSAPGNAATTQLGPYAFKIPLSIRQKICNSLDAPNSRGNDWRLLAQKLSMDRYLNYFATKASPTGVILDLWEARQQDDGDLNSLASALEEMGKSEMLVAMTTDGDC

SEQ ID NO: 35 - protein, 931 aa, Mus musculus
MRKGLRATAARCGLGLGYLLQMLVLPALALLSASGTGSAAQDDEFFHELPETFPSDPPEPLPHFLIEPEEAYIVKNKPVNLYCKASPATQIYFKCNSEWVHQKDHVVDERVDETSGLIVREVSIEISRQQVEELFGPEDYWCQCVAWSSAGTTKSRKAYVRIAYLRKTFEQEPLGKEVSLEQEVLLQCRPPEGIPVAEVEWLKNEDIIDPAEDRNFYITIDHNLIIKQARLSDTANYTCVAKNIVAKRKSTTATVIVYVNGGWSTWTEWSVCNSRCGRGYQKRTRTCTNPAPLNGGAFCEGQSVQKIACTTLCPVDGRWTSWSKWSTCGTECTHWRRRECTAPAPKNGGKDCDGLVLQSKNCTDGLCMQAAPDSDDVALYVGIVIAVTVCLAITVVVALFVYRKNHRDFESDIIDSSALNGGFQPVNIKAARQDLLAVPPDLTSAAAMYRGPVYALHDVSDKIPMTNSPILDPLPNLKIKVYNSSGAVTPQDDLAEFSSKLSPQMTQSLLENEALNLKNQSLARQTDPSCTAFGTFNSLGGHLIIPNSGVSLLIPAGAIPQGRVYEMYVTVHRKENMRPPMEDSQTLLTPVVSCGPPGALLTRPVILTLHHCADPSTEDWKIQLKNQAVQGQWEDVVVVGEENFTTPCYIQLDAEACHILTENLSTYALVGQSTTKAAAKRLKLAIFGPLCCSSLEYSIRVYCLDDTQDALKEVLQLERQMGGQLLEEPKALHFKGSIHNLRLSIHDIAHSLWKSKLLAKYQEIPFYHIWSGSQRNLHCTFTLERLSLNTVELVCKLCVRQVEGEGQIFQLNCTVSEEPTGIDLPLLDPASTITTVTGPSAFSIPLPIRQKLCSSLDAPQTRGHDWRMLAHKLNLDRYLNYFATKSSPTGVILDLWEAQNFPDGNLSMLAAVLEEMGRHETVVSLAAEGQY

SEQ ID NO: 36 - protein, 931 aa, Homo sapiens [sequence omitted]

SEQ ID NO: 37 - protein, 2302 aa, Rattus norvegicus
MMDFHFSFLFLLIGTSESQVDVSSSFDGTGYDITLSSVSATTYSSPVSRTLATNVTKPGPPVFLAGERVGSAGILLSWNTPPNPNGRIISYVVKYKEVCPWMQTAYTRARAKPDSLEVLLTNLNPGTTYEIKVAAENNAGIGVFSDPFLFQTAESAPGKVVNLTVEALNYSAVNLIWYLPRQPNGKITSFKISVKHARSGIVVKDVSLRVEDILSGKLPECNENSESFLWSTTSPSPTLGRVTPTVRTTQSSSTAARSKISSVWKEPISFVVTHLRPYTTYLFEVSAVTTEAGYIDSTIVRTPESVPEGPPQNCIMGNVTGKAFSISWDPPTIVTGKFSYRVELYGPSGRILDNSTKDLRFAFTHLTPFTMYDVYVAAETSAGVGPKSNLSVFTPPDVPGAVFDLQIAEVEATEIRITWRKPRQPNGIISQYRVKVSVLETGVVLENTLLTGQDESISNPMSPEIMNLVDPMIGFYEGSGEMSSDLHSPASFIYNSHPHNDFPASTRAEEQSSPVVTTRNQYMTDITAEQLSYVVRRLVPFTEHTISVSAFTIMGEGPPTVLTVRTREQVPSSIQIINYKNISSSSILLYWDPPEYPNGKITHYTIYATELDTNRAFQMTTVDNSFLITGLKKYTRYKMRVAASTHVGESSLSEENDIFVRTPEDEPESSPQDVQVTGVSPSELRLKWSPPEKPNGIIIAYEVLYQNADTLFVKNTSTTDIIISDLKPYTLYNISIRSYTRLGHGNQSSSLLSVRTSETVPDSAPENITYKNISSGEIEISFLPPRSPNGIIQKYTIYLKRSNSHEARTINTTSLTQTIGGLKKYTHYVIEVSASTLKGEGIRSRPISILTEEDAPDSPPQNFSVKQLSGVTVMLSWQPPLEPNGIILYYTVYVWDKSSLRAINATEASLVLSDLDYNVDYGACVTASTRFGDGNARSSIINFRTPEGEPSDPPNDVHYVNLSSSSIILFWTPPVKPNGIIQYYSVYYQNTSGTFVQNFTLLQVTKESDNVTVSARIYRLAIFSYYTFWLTASTSVGNGNKSSDIIHVYTDQDIPEGPVGNLTFESISSTAIHVSWEPPSQPNGLVFYYLSLNLQQSPPRHMIPPLVTYENSIDFDDLEKYTDYIFKITPSTEKGFSETYTTQLHIKTEEDVPDTPPIINTFKNLSSTSILLSWDPPLKPNGAILGYHLTLQGPHANHTFVTSGNHIVLEELSPFTLYSFFAAARTMKGLGPSSILFFYTDESAPLAPPQNLTLINYTSDFVWLTWSPSPLPGGIVKVYSFKIHEHETDTVFYKNISGLQTDAKLEGLEPVSTYSVSVSAFTKVGNGNQYSNVVEFTTQESVPEAVRNIECVARDWQSVSVRWDPPRKTNGIIIHYMITVGGNSTKVSPRDPTYTFTKLLPNTSYVFEVRASTSAGEGNESRCDISTLPETVPSAPTNVAFSNVQSTSATLTWTKPDTIFGYFQNYKITTQLRAQKCREWEPEECIEHQKDQYLYEANQTEETVHGLKKFRWYRFQVAASTNVGYSNASEWISTQTLPGPPDGPPENVHVVATSPFGINISWSEPAVITGPTFYLIDVKSVDDDDFNISFLKSNEENKTTEINNLEVFTRYSVVITAFVGNVSRAYTDGKSSAEVIITTLESVPKDPPNNMTFQKIPDEVTKFQLTFLPPSQPNGNIRVYQALVYREDDPTAVQIHNFSIIQKTDTSIIAMLEGLKGGHTYNISVYAINSAGAGPKVQMRITMDIKAPARPKSKPIPIRDATGKLLVTSTTITIRMPICYYNDDHGPIRNVQVLVAETGAQQDGNVTKWYDAYFNKARPYFTNEGFPNPPCIEGKTKFSGNEEIYVIGADNACMIPGNEEKICNGPLKPKKQYLFKFRATNVMGQFTDSEYSDPIKTLGEGLSERTVEIILSVTLCILSIILLGTAIFAFVRIRQKQKEGGTYSPRDAEIIDTKFKLDQLITVADLELKDERLTRLLSYRKSIKPISKKSFLQHVEELCTNSNLKFQEEFSELPKFLQDLSSTDADLPWNRAKNRFPNIKPYNNNRVKLIADVSLPGSDYINASYVSGYLCPNEFIATQGPLPGTVGDFWRMVWETRTKTLVMLTQCFEKGRIRCHQYWPEDNKPVTVFGDIVITKLMEDIQIDWTIRDLKIERHGDCMTVRQCNFTGWPEHGVPENTTPLIHFVKLVRTSRAHDTTPMVVHCSAGVGRTGVFIALDHLTQHINNHDFVDIYGLVAELRSERMCMVQNLAQYIFLHQCILDLLSNKGGHQPVCFVNYSTLQKMDSLDAMEGDVELEWEETTM

SEQ ID NO: 38 - protein, 2029 aa, Drosophila melanogaster
MGLQMTAARPIAALSLLVLSLLTWTHPTIVDAAHPPEIIRKPQNQGVRVGGVASFYCAARGDPPPSIVWRKNGKKVSGTQSRYTVLEQPGGISILRIEPVRAGRDDAPYECVAENGVGDAVSADATLTIYEGDKTPAGFPVITQGPGTRVIEVGHTVLMTCKAIGNPTPNIYWIKNQTKVDMSNPRYSLKDGFLQIENSREEDQGKYECVAENSMGTEHSKATNLYVKVRRVPPTFSRPPETISEVMLGSNLNLSCIAVGSPMPHVKWMKGSEDLTPENEMPIGRNVLQLINIQESANYTCIAASTLGQIDSVSVVKVQSLPTAPTDVQISEVTATSVRLEWSYKGPEDLQYYVIQYKPKNANQAFSEISGIITMYYVVRALSPYTEYEFYVIAVNNIGRGPPSAPATCTTGETKMESAPRNVQVRTLSSSTMVITWEPPETPNGQVTGYKVYYTTNSNQPEASWNSQMVDNSELTTVSDVTPHAIYTVRVQAYTSMGAGPMSTPVQVKAQQGVPSQPSNFRATDIGETAVTLQWTKPTHSSENIVHYELYWNDTYANQAHHKRISNSEAYTLDGLYPDTLYYIWLAARSQRGEGATTPPIPVRTKQYVPGAPPRNITAIATSSTTISLSWLPPPVERSNGRIIYYKVFFVEVGREDDEATTMTLNMTSIVLDELKRWTEYKIWVLAGTSVGDGPRSHPIILRTQEDVPGDPQDVKATPLNSTSIHVSWKPPLEKDRNGIIRGYHIHAQELRDEGKGFLNEPFKFDVVDTLEFNVTGLQPDTKYSIQVAALTRKGDGDRSAAIVVKTPGGVPVRPTVSLKIMEREPIVSIELEWERPAQTYGELRGYRLRWGVKDQALKEEMLSGPQMTKKRFDNLERGVEYEFRVAGSNHIGIGQETVKIFQTPEGTPGGPPSNITIRFQTPDVLCVTWDPPTREHRNGIITRYDVQFHKKIDHGLGSERNMTLRKAVFTNLEENTEYIFRVRAYTKQGAGPFSDKLIVETERDMGRAPMSLQAEATSEQTAEIWWEPVTSRGKLLGYKIFYTMTAVEDLDDWQTKTVGLTESADLVNLEKFAQYAVAIAARFKNGLGRLSEKVTVRIKPEDVPLNLRAHDVSTHSMTLSWSPPIRLTPVNYKISFDAMKVFVDSQGFSQTQIVPKREIILKHYVKTHTINELSPFTTYNVNVSAIPSDYSYRPPTKITVTTQMAAPQPMVKPDFYGVVNGEEILVILPQASEEYGPISHYYLVVVPEDKSNLHKIPDQFLTDDLLPGRNKPERPNAPYIAAKFPQRSIPFTFHLGSGDDYHNFTNRKLEREKRYRIFVRAVVDTPQKHLYTSSPFSEFLSLDMREAPPGERPHRPDPNWPAEPEVSVNRNKDEPEILWVVLPLMVSTFIVSTALIVLCVVKRRRQPCKTPDQAAVTRPLMAADLGAGPTPSDPVDMRRLNFQTPGMISHPPIPISEFANHIERLKSNDNQKFSQEYESIEPGQQFTWDNSNLEHNKSKNRYANVTAYDHSRVQLPAVEGVVGSDYINANYCDGYRKHNAYVATQGPLQETFVDFWRMCWELKTATIVMMTRLEERTRIKCDQYWPTRGTETYGQIFVTITETQELATYSIRTFQLCRQGFNDRREIKQLQFTAWPDHGVPDHPAPFLQFLRRCRALTPPESGPVIVHCSAGVGRTGCYIVIDSMLERMKHEKIIDIYGHVTCLRAQRNYMVQTEDQYIFIHDAILEAIICGVTEVPARNLHTHLQKLLITEPGETISGMEVEFKKLSNVKMDSSKFVTANLPCNKHKNRLVHILPYESSRVYLTPIHGIEGSDYVNASFIDGYRYRSAYIAAQGPVQDAAEDFWRMLWEHNSTIVVMLTKLKEMGREKCFQYWPHERSVRYQYYVVDPIAEYNMPQYKLREFKVTDARDGSSRTVRQFQFIDWPEQGVPKSGEGFIDFIGQVHKTKEQFGQDGPITVHCSAGVGRSGVFITLSIVLERMQYEGVLDVFQTVRILRSQRPAMVQTEDQYHFCYRAALEYLGSFDNYTN

SEQ ID NO: 39 - protein, 2037 aa, Drosophila melanogaster
MGLQMTAARPIAALSLLVLSLLTWTHPTIVDAAHPPEIIRKPQNQGVRVGGVASFYCAARGDPPPSIVWRKNGKKVSGTQSRYTVLEQPGGISILRIEPVRAGRDDAPYECVAENGVGDAVSADATLTIYEGWQKTATSGDKTPAGFPVITQGPGTRVIEVGHTVLMTCKAIGNPTPNIYWIKNQTKVDMSNPRYSLKDGFLQIENSREEDQGKYECVAENSMGTEHSKATNLYVKVRRVPPTFSRPPETISEVMLGSNLNLSCIAVGSPMPHVKWMKGSEDLTPENEMPIGRNVLQLINIQESANYTCIAASTLGQIDSVSVVKVQSLPTAPTDVQISEVTATSVRLEWSYKGPEDLQYYVIQYKPKNANQAFSEISGIITMYYVVRALSPYTEYEFYVIAVNNIGRGPPSAPATCTTGETEMESAPRNVQVRTLSSSTMVITWEPPETPNGQVTGYKVYYTTNSNQPEASWNSQMVDNSELTTVSELTPHAIYTVRVQAYTSMGAGPMSTPVQVKAQQGVPSQPSNFRATDIGETAVTLQWTKPTHSSENIVHYELYWNDTYANQAHHKRISNSEAYTLDGLYPDTLYYIWLAARSQRGEGATTPPIPVRTKQYVPGAPPRNITAIATSSTTISLSWLPPPVERSNGRIIYYKVFFVEVGREDDEATTMTLNMTSIVLDELKRWTEYKIWVLAGTSVGDGPRSHPIILRTQEDVPGDPQDVKATPLNSTSIHVSWKPPLEKDRNGIIRGYHIHAQELRDEGKGFLNEPFKFDVVDTLEFNVTGLQPDTKYSIQVAALTRKGDGDRSAAIVVKTPGGVPVRPTVSLKIMEREPIVSIELEWERPAQTYGELRGYRLRWGVKDQALKEEMLSGPQMTKKRFDNLERGVEYEFRVAGSNHIGIGQETVKIFQTPEGTPGGPPSNITIRFQTPDVLCVTWDPPTREHRNGIITRYDVQFHKKIDHGLGSERNMTLRKAVFTNLEENTEYIFRVRAYTKQGAGPFSDKLIVETERDMGRAPMSLQAEATSEQTAEIWWEPVTSRGKLLGYKIFYTMTAVEDLDDWQTKTVGLTESADLVNLEKFAQYAVAIAARFKNGLGRLSEKVTVRIKPEDVPLNLRAHDVSTHSMTLSWSPPIRLTPVNYKISFDAMKVFVDSQGFSQTQIVPKREIILKHYVKTHTINELSPFTTYNVNVSAIPSDYSYRPPTKITVTTQMAAPQPMVKPDFYGVVNGEEILVILPQASEEYGPISHYYLVVVPEDKSNLHKIPDQFLTDDLLPGRNKPERPNAPYIAAKFPQRSIPFTFHLGSGDDYHNFTNRKLEREKRYRIFVRAVVDTPQKHLYTSSPFSEFLSLDMREAPPGERPHRPDPNWPAEPEVSVNRNKDEPEILWVVLPLMVSTFIVSTALIVLCVVKRRRQPCKTPDQAAVTRPLMAADLGAGPTPSDPVDMRRLNFQTPGMISHPPIPISEFANHIERLKSNDNQKFSQEYESIEPGQQFTWDNSNLEHNKSKNRYANVTAYDHSRVQLPAVEGVVGSDYINANYCDGYRKHNAYVATQGPLQETFVDFWRMCWELKTATIVMMTRLEERTRIKCDQYWPTRGTETYGQIFVTITETQELATYSIRTFQLCRQGFNDRREIKQLQFTAWPDHGVPDHPAPFLQFLRRCRALTPPESGPVIVHCSAGVGRTGCYIVIDSMLERMKHEKIIDIYGHVTCLRAQRNYMVQTEDQYIFIHDAILEAIICGVTEVPARNLHTHLQKLLITEPGETISGMEVEFKKLSNVKMDSSKFVTANLPCNKHKNRLVHILPYESSRVYLTPIHGIEGSDYVNASFIDGYRYRSAYIAAQGPVQDAAEDFWRMLWEHNSTIVVMLTKLKEMGREKCFQYWPHERSVRYQYYVVDPIAEYNMPQYKLREFKVTDARDGSSRTVRQFQFIDWPEQGVPKSGEGFIDFIGQVHKTKEQFGQDGPITVHCSAGVGRSGVFITLSIVLERMQYEGVLDVFQTVRILRSQRPAMVQTEDQYHFCYRAALEYLGSFDNYTN

SEQ ID NO: 40 - protein, 1767 aa, Drosophila melanogaster
MDCATRKQQQLRAHHQQQQIQIQTHGRKRQQLQKQRHNHHHYYQNSQQQQKHFVWLVVGILTIFLAQHANAADLVINVPNASSNANAFYRIDYSPPFGFPEPNTTIPASDIGKDIKFSRALPGTEYNFWLYYTNSTHREQLTWTVNITTAPDPPANLSVQLRSSKSAFITWRPPGSGRYSGFRIRVLGLTDLPFERSYSLEGNETLQLSAKELTPGGSYQVQAYSVYQGKESVAYTSRNFTTKPNTPGKFIVWFRNETTLLVLWQPPFPAGIYTHYRVSITPDDAIQSVLYVEREGEPPGPAQAAFKGLVPGREYNISVQTVSEDETSSVPTTARYLTVPERVLNVTFDEAYTTSSSFRVRWEPPRTYSEFDAYQVMLSTSRRIFNVPRAANGDSVYFDYPDILEPGRTYEVVVKTIADNVNSWPASGEVTLRPRPVRSLGGFLDDRSNALHISWEPAETGRQDSYRISYHEQTNASEVPAPFPVAAESQITTNLTEYTLDSLLAGRRYLIAVQALSKGVASNASDITRYTRPAAPLIQELRSIDQGLMLSWRSDVNSRQDRYEVHYQRNGTREERTMATNETSLTIHYLHPGSGYEVKVHAISHGVRSEPHSYFQAVFPKPPQNLTLQTVHTNLVVLHWQAPEGSDFSEYVVRYRTDASPWQRISGLHENEARIKDMHYGERYLVQVNTVSFGVESPHPLELNVTMPPQPVSNVVPLVDSRNLTLEWPRPDGHVDFYTLKWWPTDEEDRVEFKNVTQLEDLSSPSVRIPIEDLSPGRQYRFEVQASSNGIRSGTTHLSTRTMPLIQSDVFIANAGHEQGQDETITLSYTPTPADSTRFDIYRFSMGDPTIKDKEKLANDTERKLSFSGLTPGKLYNVTVWTVSGGVASLPVQRLYRLHPLPISDLKAIQVAAREITLHWTAPAGEYTDFELQYLSADEEAPQLLQNVTKNTEITLQGLRPYHNYTFTVVVRSGSIQGTDFADVSVSTLMRSSAPISASYQTLTAPPGKVDYFQPSDVQPGEVTFEWSLEPAEQHGPIDYFRITCQNADDAADVSSYEFPVNATQGKIDGLVPGNHYIFRIQAKSALGYGAEREHIQTMPILAPPVPEPSVTPLEVSRTSSTIEISFRQGYFSNAHGMVRSYTIIIAEDVGKNASGLEMPSWQDVQAYTVWLPYQAIEPYNPFLTSNGSRKSSLEAEHFTIGTANCDKHQAGYCNGPLRAGTTYRIKIRAFTDEDKFTDTVYSSPITTERSDTVIVAATVSAVLLVAMVLVVVYCQHRCQLIRRASKLARMQDELAALPEGYITPNRPVHVKDFSEHYRIMSADSDFRFSEEFEELKHVGRDQACSFANLPCNRPKNRFTNILPYDHSRFKLQPVDDDDGSDYINANYMPGHNSPREFIVTQGPLHSTREEFWRMCWESNSRAIVMLTRCFEKGREKCDQYWPVDRVAMFYGDIKVQLIIDTHYHDWSISEFMVSRNCESRIMRHFHFTTWPDFGVPEPPQSLVRFVRAFRDVIGTDMRPIIVHCSAGVGRSGTFIALDRILQHIHKSDYVDIFGIVFAMRKERVFMVQTEQQYVCIHQCLLAVLEGKEHLLADSLELHANDGYEVTKIYLERQPQTKMGTLPIRASLAMAEKLDADLMTNKDEDEDQEQQQQQQLQLATEVKPKGSNDDEEDEEDDDDDDDDQQPLNNETTATLSSASCSSSTHDVHVVLQEAIEKPKQEQERICAGTQSHADTESDNTDSDDDDEDGDGKVAKDGAVADEDGWWY

SEQ ID NO: 41 - protein, 1767 aa, Drosophila melanogaster
MDCATRKQQQLRAHHQQQQIQIQTHGRKRQQLQKQRHNHHHYYQNPQQQQKHFVWLVVGILTIFLARHANAADLVINVPNASSNANAFYRIDYSPPFGFPEPNTTIPASDIGKDIKFSRALPGTEYNFWLYYTNSTHREQLTWTVNITTAPDPPANLSVQLRSSKSAFITWRPPGSGRYSGFRIRVLGLTDLPFERSYSLEGNETLQLSAKELTPGGSYQVQAYSVYQGKESVAYTSRNFTTKPNTPGKFIVWFRNETTLLVLWQPPFPAGIYTHYRVSITPDDAIQSVLYVEREGEPPGPAQAAFKGLVPGREYNISVQTVSEDETSSVPTTARYLTVPERVLNVTFDEAYTTSSSFRVRWEPPRTYSEFDAYQVMLSTSRRIFNVPRAANGDSVYFDYSDILEPGRTYEVVVKTIADNVNSWPASGEVTLRPRPVRSLGGFLDDRSNALHISWEPAETGRQDSYRISYHEQTNASEVPAPFPVAAESQITTNLTEYTLDSLLAGRRYLIAVQALSKGVASNASDITRYTRPAAPLIQELRSIDQGLMLSWRSDVNSRQDRYEVHYQRNGTREERTMATNETSLTIHYLHPGSGYEVKVHAISHGVRSEPHSYFQAVFPKPPQNLTLQTVHTNLVVLHWQAPEGSDFSEYVVRYRTDASPWQRISGLHENEARIKDMHYGERYLVQVNTVSFGVESPHPLELNVTMPPQPVSNVVPLVDSRNLTLEWPRPDGHVDFYTLKWWPTDEEDRVEFKNVTQLEDLSSPSVRIPIEDLSPGRQYRFEVQASSNGIRSGTTHLSTRTMPLIQSDVFIANAGHEQGQDETITLSYTPTPADSTRFDIYRFSMGDPTIKDKEKLANDTERKLSFSGLTPGKLYNVTVWTVSGGVASLPVQRVYRLHPLPISDLKAIQVAAREITLHWTAPAGEYTDFELQYLSADEEAPQLLQNVTKNTEITLQGLRPYHNYTFTVVVRSGSIQGTDFADVSVSTLMRSSAPISASYQTLTAPPGKVDYFQPSDVQPGEVTFEWSLEPAEQHGPIDYFRITCQNADDAADVSSYEFPVNATQGKIDGLVPGNHYIFRIQAKSALGYGAEREHIQTMPILAPPVPEPSVTPLEVSRTSSTIEISFRQGYFSNAHGMVRSYTIIIAEDVGKIASGLEMPSWQDVQAYTVWLPYQAIEPYNPFLTSNGSRKSSLEAEHLTIGTANCDKHQAGYCNGPLRAGTTYRIKIRAFTDEDKFTDTVYSSPITTERSDTVIVAATVSAVLLVAMVLVVVYCQHRCQLIRRASKLARMQDELAALPEGYITPNRPVHVKDFSEHYRIMSADSDFRFSEEFEELKHVGRDQACSFANLPCNRPKNRFTNILPYDHSRFKLQPVDDDDGSDYINANYMPGHNSPREFIVTQGPFHSTREEFWRMCWESNSRAIVMLTRCFEKGREKCDQYWPVDRVAMFYGDIKVQLIIDTHYHDWSISEFMVSRNCESRIMRHFHFTTWPDFGVPEPPLSLVRFVRAFRDVIGTDMRPIIVHCSAGVGRSGTFIALDRILQHIHKSDYVDIFGIVFAMRKERVFMVQTEQQYVCIHQCLLAVLEGKEHLLADSLELHANDGYEVTKIYLERQPQTKMGTLPIRASLAMAEKLDADLMTNKDEDEDQEQQQQQQLQLATEVKPKGSNDDEEDEEDDDDDDDDQQPLNNETTATLSSASCSSSTHDVHVVLQEAIEKPKQEQERICAGTQSHADTESDNTDSDDDDEDGDGKVAKDGAVADEDGWWY

SEQ ID NO: 42 - protein, 619 aa, Homo sapiens [sequence omitted]

SEQ ID NO: 43 - protein, 2341 aa, Homo sapiens
MGSQTLQILRQGVWAALSGGWYYDPHQATFVNALHLYLWLFLLGLPFTLYMALPSTMIIVAVYCPVIAAVFIVLKMVNYRLHRALDAGEVVDRTANEFTDQRTKAEQGNCSTRRKDSNGPSDPGGGIEMSEFIREATPPVGCSSRNSYAGLDPSNQIGSGSSRLGTAATIKGDTDTAKTSDDISLSLGQSSSLCKEGSEEQDLAADRKLFRLVSNDSFISIQPSLSSCGQDLPRDFSDKVNLPSHNHHHHVDQSLSSACDTEVASLVPLHSHSYRKDHRPRGVPRTSSSAVAFPDTSLNDFPLYQQRRGLDPVSELESSKPLSGSKESLVENSGLSGEFQLAGDLKINTSQPPTKSGKSKPLKAEKSMDSLRSLSTRSSGSTESYCSGTDRDTNSTVSSYKSEQTSSTHIESILSEHEESPKAGTKSGRKKECCAGPEEKNSCASDKRTSSEKIAMEASTNSGVHEAKDPTPSDEMHNQRGLSTSASEEANKNPHANEFTSQGDRPPGNTAENKEEKSDKSAVSVDSKVRKDVGGKQKEGDVRPKSSSVIHRTASAHKSGRRRTGKKRASSFDSSRHRDYVCFRGVSGTKPHSAIFCHDEDSSDQSDLSRASSVQSAHQFSSDSSSSTTSHSCQSPEGRYSALKTKHTHKERGTDSEHTHKAHLVPEGTSKKRATRRTSSTNSAKTRARVLSLDSGTVACLNDSNRLMAPESIKPLTTSKSDLEAKEGEVLDELSLLGRASQLETVTRSRNSLPNQVAFPEGEEQDAVSGAAQASEEAVSFRRERSTFRRQAVRRRHNAGSNPTPPTLLIGSPLSLQDGQQGQQSTAQVKVQSRPPSQAAVLSASASLLVRNGSVHLEASHDNASAVGGSSLHDELGKFSSTLYETGGCDMSLVNFEPAARRASNICDTDSHVSSSTSVRFYPHDVLSLPQIRLNRLLTIDTDLLEQQDIDLSPDLAATYGPTEEAAQKVKHYYRFWILPQLWIGINFDRLTLLALFDRNREILENVLAVILAILVAFLGSILLIQGFFRDIWVFQFCLVIASCQYSLLKSVQPDSSSPRHGHNRIIAYSRPVYFCICCGLIWLLDYGSRNLTATKFKLYGITFTNPLVFISARDLVIVFTLCFPIVFFIGLLPQVNTFVMYLCEQLDIHIFGGNATTSLLAALYSFICSIVAVALLYGLCYGALKDSWDGQHIPVLFSIFCGLLVAVSYHLSRQSSDPSVLFSLVQSKIFPKTEEKNPEDPLSEVKDPLPEKLRNSVSERLQSDLVVCIVIGVLYFAIHVSTVFTVLQPALKYVLYTLVGFVGFVTHYVLPQVRKQLPWHCFSHPLLKTLEYNQYEVRNAATMMWFEKLHVWLLFVEKNIIYPLIVLNELSSSAETIASPKKLNTELGALMITVAGLKLLRSSFSSPTYQYVTVIFTVLFFKFDYEAFSETMLLDLFFMSILFNKLWELLYKLQFVYTYIAPWQITWGSAFHAFAQPFAVPHSAMLFIQAAVSAFFSTPLNPFLGSAIFITSYVRPVKFWERDYNTKRVDHSNTRLASQLDRNPGSDDNNLNSIFYEHLTRSLQHSLCGDLLLGRWGNYSTGDCFILASDYLNALVHLIEIGNGLVTFQLRGLEFRGTYCQQREVEAITEGVEEDEGFCCCEPGHIPHMLSFNAAFSQRWLAWEVIVTKYILEGYSITDNSAASMLQVFDLRKVLTTYYVKGIIYYVTTSSKLEEWLANETMQEGLRLCADRNYVDVDPTFNPNIDEDYDHRLAGISRESFCVIYLNWIEYCSSRRAKPVDVDKDSSLVTLCYGLCVLGRRALGTASHHMSSNLESFLYGLHALFKGDFRISSIRDEWIFADMELLRKVVVPGIRMSIKLHQDHFTSPDEYDDPTVLYEAIVSHEKNLVIAHEGDPAWRSAVLANSPSLLALRHVMDDGTNEYKIIMLNRRYLSFRVIKVNKECVRGLWAGQQQELVFLRNRNPERGSIQNAKQALRNMINSSCDQPIGYPIFVSPLTTSYSDSHEQLKDILGGPISLGNIRNFIVSTWHRLRKGCGAGCNSGGNIEDSDTGGGTSCTGNNATTANNPHSNVTQGSIGNPGQGSGTGLHPPVTSYPPTLGTSHSSHSVQSGLVRQSPARASVASQSSYCYSSRHSSLRMSTTGFVPCRRSSTSQISLRNLPSSIQSRLSMVNQMEPSGQSGLACVQHGLPSSSSSSQSIPACKHHTLVGFLATEGGQSSATDAQPGNTLSPANNSHSKKAEVIYRVQIVDPSQILEGINLSKRKELQWPDEGIRLKAGRNSWKDWSPQEGMEGHVIHRWVPCSRDPGTRSHIDKAVLLVQIDDKYVTVIETGVLELGAEV

SEQ ID NO: 44 - protein, 1446 aa, Mus musculus
MSLVNFEPAARRASNICDTDSHVSSSTSVRFYPHDMIRLNRLLTIDTDLLEQQDIDLSPDLAATYGPTEEAAQKVKHYYRFWVLPQLWIGINFDRLTLLALFDRNREILENILAVVLAILVAFLGSILLIQGFFRDIWVFQFCLVIASCQYSLLKSVQPDSSSPRHGHNRIIAYSRPVYFCLCCGLIWLLDYGSRNLTTSKFKLYGVTFTNPLVLLSARDLVIVFTLCFPIVFFIGLLPQVNTFVMYLCEQLDIHIFGGNATTSLLAALYSFLCSIVAVALLYGLCYGALRDSWDGQHVPVLFSVFCGLLVAVSYHLSRQSNDPSVLFSLMQSKIFPKADEKNPEDPLSEVKDPLPEKLSNSVSERLQSDLVVCVIIGVLYFAIHVSTVFTALQPALKYVLYALVGVVGLVTHYVLPQVRKQLPWHCFSRPLLRTAEHSQYEVRNAATMMWFEKLHVWLLFVEKNIIYPLIVLNELSSSAETIASPKKLDTELGALMITIAGLKLLRSSFSSPTYQYITVIFTVLFFKFDYEAFSETMLLDLFFMSILFSKLWELLYKRQFVYTYVAPWQITWGSAFHAFAQPFAVPHSAMLFVQAIVSAFFSTPLNPFLGSAIFITSYVRPVKFWERDYNTKRVDHSNTRLASQLDRNPGSDDNNLNSIFYEHLTRSLQHSLCGDLLLGRWGNYSTGDCFILASDYLNALVHLIEIGNGLVTFQLRGLEFRGTYCQQREVEAITEGVEEDEGFCCCEPGHVPHVLSFNAAFGQRWLAWEVVVTKYILEGYSITDNSAASMLQVFDLRRVLTTYYVKGIIYYVTTSSKLEEWLANETMQEGLRLCADRNYVDVDPTFNPNIDEDYDHRLAGISRESFCVIYLSWIEYCSSRRAKPLDVDKDSSLVTLCYGLCVLGRRALGTASHHMSSNLESFLYGLHALFKGDFRISSVRDEWIFADMELLRKVVVPGIRMSIKLHQDHFTSPDEYDDPTVLYEAIVSHEKNLVIAHEGDPAWRSAVLANSPSLLALRHVMDDGTNEYKIIMLNRRYLSFRVIKVNKECVRGLWAGQQQELVFLRNRNPERGSIQNAKQALRNMINSSCDQPIGYPIFVSPLTTSYSDSHDQLKEILGGPISLGNIRNFIVSTWHRLRKGCGAGCNSGGNIEDSDTGGGTSCPGNSAVTASDPHNNVSQGSTGHPGQGAGSGLHPPTTSYPPTLGTSHSAHSVQSSLVRQSPARASMASQSSYCYSSRHSSLRMSTTGFVPCRRSSTSQISLRNLPSSIQSRLSMVNQMEAASQGGMGCVQHGLPSSSSSSQSIPACKHHTLVAFLGAEGGQGSATEAQPGNTSSPANISHARKGEVIYRVQIVDLSQILEGINVSKRKELHWPDEGIRLKAGRNSWKDWSPQEGMEGHVVHRWVPCSRDPSTRSHIDNTVLLVQIDDKYVTIIETGVLELGAEV

SEQ ID NO: 45 - protein, 1703 aa, Takifugu rubripes
MGSQTLQILRQGVWASVTGGWYYDPDQNTFVNALHLYIWLFLLCFPFTLYMALQPSMVIVGIYCGVIAAMFLLLKTVNYRLHHALDEGEVVEHQTRESKGSRGGTGGANDPVTRREDSNGLGDPGGGIEMADFIRQETPPVDCSSRNSYVGMDLNQRMSSTHGRTTVAKAPGSEETVIFRRERSTFRRQAVRRRHNAGSNPTPPTSLIGSPLRYALHEADRPSGVRSWYRTVKSQPSRTPSQVTVLSTSASLLARNGSTHLEGSQDKASTVGTTSLQDEFGTLTPSLYEIRGCHIGLGNFESATRRASNNIWDTDSHLSSSTSVRFYPHDLISLHHIRANRLLTMDPELLEQQDDLSPDLQDAPLGQDNPSAASAAGKTRQYYRLWLLPFLWVGLHFDRLTLLALFDRNREVLENVLAVVLAVLVAFLGSVLLIHGFFADIWVFQFCLVIASCQYSLLKSVQPDSSSPRHGHNRIIAYSRPVYFCLCCGLIWLLHYGSLRTTSSRFTLYGVALTSSLVLASARDLVIVFTLCFPIIFFVGLLPQVNTFVMYLFEQLDIHVFGGNASTSLLSALYSILRSIVTVALLYCFCYGALKENWEPHHIPVLFSVFCGLLVAVSYHLSRQSSDPSVLMYVPLSKVFPQLRSKNPEDPLSEVQDPLPEKLRASVNERLQSDLIVCVVIAVLYFAIHVSTVFIALQPYLSYVLYGLLGAVGLLTHYLLPQLRKQLPWYCFSHPLLKTKEYYQFEVRDAAHVMWFEKFHVWLLFVEKNVLYPLVILNELSGSARELASPKRLDTEVGALMITVAGLKLLRSSYSSPTYQYITILFTVLFFTLDHRHLSETLLLDLFLMSIIFSKMWELFYKLHFVYTYIAPWQITWGSAFHAFAQPFAVPHSAMLFVQAVVSSIFSTPLNPFLGSAIFITSYVRPVKFWERDYNTKRVDHSNTRLASQLDRNPGSDDNNLNSIFYEHLTRSLQHSLCGDLLLGRWGNFSTGDCFILASDYLNALVHLIEIGNGLVTFQLRGLEFRGTYCQQREVEAITEGVEEDEGCCCCEPGHLPHILSFNAAFGQRWLAWEVVVTKYVLEGYSITDNSAASMLQVFELRRILTTYYVKGIIYYVIASPKLEEWLANDTMKEGLRGCSERNYVDLDATFNPNIDEDYDHRLSGISRDSFCGVYLGWIQYCNSRRTKPLDSEKDSALVLLCFGLCVLGRRALGTAAHQMSSNLESFLYGLHALFKGDFRISSVRDEWIFADMELLRKVVVPGIRMSLKLHQDHFTSPDEYDEPAVLFEAISTHQQNLVIAHEGDPAWRSAVLSNAPSLLALRHVLDEGTNEYKIIMLNRRYLSFRVIKVNKECVRGLWAGQQQELVFLRNRNPERGSIQNAKQALRNMINSSCDQPIGYPIYVSPLTTSYCNSHPQLRHILGGPISFGNIRNFVVSTWHRLRKGCGAGCNSGGNIEDSDAGGLSCGTSQSSQSVQSGLVRHSPARASVVSQSSSYRYSSSRHSSLRTSTTGLEPCRRSSTSQLSLRTLPTSLQLRLGSTSDPAGPSSSLSSHSIPPCKRHTLVGLLGNDGLCSTVTDPLSQHHHPHHHPQQHNPTHATVRRDDISYRVQIVDVGQVLENINLSKRKELQWPDDAMRHKAGRTCWRDWSPLEGMEGHVIHRWVPCSRDPGSRSHIDKTILLVQVEDKIVPIIETGVIELGAEV

SEQ ID NO: 46 - protein, 552 aa, Drosophila melanogaster
MSTEESSPDSEYTSAVPVDCRVTDLKENEMKQVDFDEDTRVLLVKQNDRLLAVGAKCTHYGAPLQTGALGLGRVRCPWHGACFNLENGDIEDFPGLDSLPCYRVEVGNEGQVMLRAKRSDLVNNKRLKNMVRRKPDDQRVFIVVGGGPSGAVAVETIRQEGFTGRLIFVCREDYLPYDRVKISKAMNLEIEQLRFRDEEFYKEYDIELWQGVAAEKLDTAQKELHCSNGYVVKYDKIYLATGCSAFRPPIPGVNLENVRTVRELADTKAILASITPESRVVCLGSSFIALEAAAGLVSKVQSVTVVGRENVPLKAAFGAEIGQRVLQLFEDNKVVMRMESGIAEIVGNEDGKVSEVVLVDDTRLPCDLLILGTGSKLNTQFLAKSGVKVNRNGSVDVTDFLESNVPDVYVGGDIANAHIHGLAHDRVNIGHYQLAQYHGRVAAINMCGGVKKLEAVPFFFTLIFGKGIRYAGHGSYKDVIIDGSMEDFKFVAYFINEADTVTAVASCGRDPIVAQFAELISQGKCLGRGQIEDPATREDWTKKLGQPLPQVR

SEQ ID NO: 47 - protein, 403 aa, Homo sapiens [sequence omitted]

SEQ ID NO: 48 - protein, 403 aa, Homo sapiens
MDRSKENCISGPVKATAPVGGPKRVLVTQQFPCQNPLPVNSGQAQRVLCPSNSSQRIPLQAQKLVSSHKPVQNQKQKQLQATSVPHPVSRPLNNTQKSKQPLPSAPENNPEEELASKQKNEESKKRQWALEDFEIGRPLGKGKFGNVYLAREKQSKFILALKVLFKAQLEKAGVEHQLRREVEIQSHLRHPNILRLYGYFHDATRVYLILEYAPLGTVYRELQKLSKFDEQRTATYITELANALSYCHSKRVIHRDIKPENLLLGSAGELKIADFGWSVHAPSSRRTTLCGTLDYLPPEMIEGRMHDEKVDLWSLGVLCYEFLVGKPPFEANTYQETYKRISRVEFTFPDFVTEGARDLISRLLKHNPSQRPMLREVLEHPWITANSSKPSNCQNKESASKQS

SEQ ID NO: 49 - protein, 403 aa, Homo sapiens
MDRSKENCISGPVKATAPVGGPKRVLVTQQIPCQNPLPVNSGQAQRVLCPSNSSQRVPLQAQKLVSSHKPVQNQKQKQLQATSVPHPVSRPLNNTQKSKQPLPSAPENNPEEELASKQKNEESKKRQWALEDFEIGRPLGKGKFGNVYLAREKQSKFILALKVLFKAQLEKAGVEHQLRREVEIQSHLRHPNILRLYGYFHDATRVYLILEYAPLGTVYRELQKLSKFDEQRTATYITELANALSYCHSKRVIHRDIKPENLLLGSAGELKIADFGWSVHAPSSRRTTLCGTLDYLPPEMIEGRMHDEKVDLWSLGVLCYEFLVGKPPFEANTYQETYKRISRVEFTFPDFVTEGARDLISRLLKHNPSQRPMLREVLEHPWITANSSKPSNCQNKESASKQS

SEQ ID NO: 50 - protein, 403 aa, Homo sapiens
MDRSKENCISGPVKATAPVGGPKRVLVTQQFPCQNPLPVNSGQAQRVLCPSNSSQRIPLQAQKLVSSHKPVQNQKQKQLQQTSVPHPVSRPLNNTQKSKQPLPSAPENNPEEELASKQKNEESKKRQWALEDFEIGRPLGKGKFGNVYLAREKQSKGILALKVLFKAQLEKAGVEHQLRREVEIQSHLRHPNILRLYGYFHDATRVYLILEYAPLGTVYRELQKLSKFDEQRTATYITELANALSYCHSKRVIHRDIKPENLLLGSAGELKIADFGWSVHAPSSRRTTLCGTLDYLPPEMIEGRMHDEKVDLWSLGVLCYEFLVGKPPFEANTYQETYKRISRVEFTFPDFVTEGARDLISRLLKHNPSQRPMLREVLEHPWITANSSKPSNCQNKESASKQS

SEQ ID NO: 51 - protein, 402 aa, Homo sapiens
MDRSKENCISGPVKATAPVGGPKRVLVTQQFPCQNPLPVNSGQAQRVLCPSNSSQRVPLQAQKLVSSHKPVQNQKQKQLQATSVPHPVSRPLNNTQKSKQPLPSHLKIILRRNWHQNRKMKNQKEAVALEDFEIGRPLGKGKFGNVYLAREKQSKFILALKVLFKAQLEKAGVEHQLRREVEIQSHLRHPNILRLYGYFHDATRVYLILEYAPLGTVYRELQKLSKFDEQRTANLYNRIANALSYCHSKRVIHRDIKPENLLLGSAGELKIADFGWSVHAPSSRRTTLCGTLDYLPPEMIEGRMHDEKVDLWSLGVLCYEFLVGKPPFEANTYQETYKRISRVEFTFPDFVTEGARDLISRLLKHNPSQRPMLREVLEHPWITANSSKPSNCQNKESASKQS

SEQ ID NO: 52 - protein, 440 aa, Homo sapiens [sequence omitted]

SEQ ID NO: 53 - protein, 440 aa, Mus musculus
MGQSQSGGHGPGGGKKDDKDKKKKYEPPVPTRVGKKKKKTKGPDAASKLPLVTPHTQCRLKLLKLERIKDYLLMEEEFIRNQEQMKPLEEKQEEERSKVDDLRGTPMSVGTLEEIIDDNHAIVSTSVGSEHYVSILSFVDKDLLEPGCSVLLNHKVHAVIGVLMDDTDPLVTVMKVEKAPQETYADIGGLDNQIQEIKESVELPLTHPEYYEEMGIKPPKGVILYGPPGTGKTLLAKAVANQTSATFLRVVGSELIQKYLGDGPKLVRELFRVAEEHAPSIVFIDEIDAIGTKRYDSNSGGEREIQRTMLELLNQLDGFDSRGDVKVIMATNRIETLDPALIRPGRIDRKIEFPLPDEKTKKRIFQIHTSRMTLADDVTLDDLIMAKDDLSGADIKAICTEAGLMALRERRMKVTNEDFKKSKENVLYKKQEGTPEGLYL

SEQ ID NO: 54 - protein, 440 aa, Homo sapiens
MGQSQSGGHGPGGGKKDDEDKKKKYEPPVPTRVGKKKKKRKGPDAASKLPLVTPHTQCRLKLLKLERIKDYLLMEEEFIRNQEQMKPLEEKQEEERSKVDDLRGTPMSVGTLEEIIDDNHAIVSTSVGSEHYVSILSFVDKDLLEPGCSVLLNHKVHAVIGVLMDDTDPLVTVMKVEKAPQETYADIGGLDNQIQEIKESVELPLTHPEYYEEMGIKPPKGVILYGPPGTGKTLLAKAVANQTSATFLRVVGSELIQKYLGDGPKLVRELFRVAEEHAPSIVFIDEIDAIGTKRYDSNSGGEREIQRTMLELLNQLDGFDSRGDVKVIMATNRIETLDPALIRPGRIDRKIEFPLPDEKTKKRIFQIHTSRMTLADDVTLDDLIMAKDDLSGADIKAICTEAGLMALRERRMKVTNEDFKKSKENVLYKKQEGTPEGLYL

SEQ ID NO: 55 - protein, 440 aa, Homo sapiens
MGQSQSGGHGPGGGKKDDKDKKKKYEPPVPTRVGKKKKKTKGPDAASKLPLVTPHTQCRLKLLKLERIKDYLLMEEEFIRNQEQMKPLEEKQEEERSKVDDLRGTPMSVGTLEEIIDDNRAIVSTSVGSEHYVSILSFVDKDLLEPGCSVLLNHKVHAVIGVLMDDTDPLVTVMKVEKAPQETYADIGGLDNQIQEIKESVELPLTHPEYYEEMGIKPPKGVILYGPPGTGKTLLAKAVANQTSATFLRVVGSELIQKYLGDGPKLVRELFRVAEEHAPSIVFIDEIDAIGTKRYDSNSGGEREIQRTMLELLNQLDGFDSRGDVKVIMATNRIETLDPALIRPGRIDRKIEFPLPDEKTKKRIFQIHTSRMTLADDVTLDDLIMAKDDLSGADIKAICTEAGLMALRERRMKVTNEDFKKSKENVLYKKQEGTPEGLYL

SEQ ID NO: 56 - protein, 440 aa, Gallus gallus
MGQSQSGGHGPGGGKKDDKDKKKKYEPPVPTRVGKKKKKTKGPDAASKPPLVTPHTQCRLKLLKLERIKDYLLMEEEFIRNQEQMKPLEEKQEEERSKVDDLRGTPMSVGTLEEIIDDNHAIVSTSVGSEHYVSILSFVDKDLLEPGCSVLLNHKVHAVIGVLMDDTDPLVTVMKLEKAPQETYADIGGLDNQIQEIKESVELPLTHPEYYEEMGIKPPKGVILYGPPGTGKTLLAKAVANQTSATFLRVVGSELIQKYLGDGPKLVRELFRVAEEHGPSIVFIDEIDAIGTKRYDSNSGGEREIQRTMLELLNQLDGFDSRGDVKVIMATNRIETLDPALIRPGRIDRKIEFPLPDEKTKKRIFQIHTSRMTLADDVTLDELIMAKDDLSGADIKAICTEAGLMALRERRMKVTNEDFKKSKENFLYKKTEGTPEGLYL

SEQ ID NO: 57 - protein, 264 aa, Oryctolagus cuniculus
MSSTESPSRAADKSPRQQVDRLLEGLRWRRLEEPLGFIKVLQWLFAIFAFGSCGSYSGETGAMVRCNNEAKDVSSIIVLFGYPFRLHRIEYEMPLCDDDSSSKTMHLMGDFSAPAEFFVTLGIFSFFYTMAALVVYLRFHKLYTENKRFPLVDFCVTVSFTFFWLVAAAAWGKGLTDVKGATRPSSLTAAMSVCHGEEAVCSAGATPSMGLANISVLFGFINFFLWAGNCWFVFKETPWHGQGQDQGQGPSQESAAEQGAVEKQ

SEQ ID NO: 58 - protein, 264 aa, Mus musculus
MSSTESPGRTSDKSPRQQVDRLLLGLRWQRLEEPLGFIKVLQWLFAIFAFGSCGSYSGETGALVLCNNEAKDVSSIIVLFGYPFRLYQVQYEMPLCDQDSTSKTMNLMGDFSAPAEFFVTLGIFSFFYTMAALVIYLRFHKLYTENKRFPLVDFCVTVSFTFFWLVAAAAWGKGLTDVKGATRPSSLTAAMSVCHGEEAVCSAGATPSMGLANLSVLFGFINFFLWAGNCWFVFKETPWHGQGQDQGQGPSQESAAEQGAVEKQ

SEQ ID NO: 59 - protein, 285 aa, Mus musculus
MDPVSQVASAGTFRALKEPLAFLRALELLFAMFAFATCGGYSGGLRLSVDCVNKTESNLSIDIAFAYPFRLQQVTFEVPTCEGKEQQKLALVGDSSSSAEFFVTVAVFAFLYSLAATVVYIFFQNKYRENNRGPLIDFIVTVVFSFLWLVGSSAWAKGLSDVKVATDPKEVLLLMSACKQPSNKCMAVHSPVMSSLNTSVVFGFLNFILWAGNIWFVFKETGWHSSGQRYLSDPMEKHSSSYNQGRYNQESYGSSGGYSQQANLGPTSDEFGQQPSGPTSFNNQI

SEQ ID NO: 60 - protein, 307 aa, Bos taurus
MDVVNQLVAGGQFRVVKEPLGFVKVLQWVFAIFAFATCGSYSGELQLSVDCANKTKSDLNIEVEFEYPFRLHEVYFEAPTCQGDPKKIFLVGNYSSSAEFFVTVAVFAFLYSMGALATYIFLQNKYRENNKGPMLDFLATAVFAFMWLVSSSAWAKGLSDVKMATDPENIIKGMHVCHQPGNTCKELRDPVTSGLNTSVVFGFLNLVLWVGNLWFVFKETGWAAPFLRAPPGAPEKQPAPGDAYGQAGYGQGPGGYGPQDSYGPQGGYQPDYGQPASSGGGGYGPQGDYGQQGYGPQGAPTSFSNQM

SEQ ID NO: 61 - protein, 268 aa, Gallus gallus
MCMVIFAPLFAIFAFATCGGYSGGLRLSVDCANKSESDLNIDIAFAYPFRLHQVNFDAPTCEGKRRETLSLIGDFSSSAEFFVTIAVFAFLYSLAATVVYIFFQNKYRENNRGPLIDFIVTVVFSFLWLVGSSAWAKGLSDVKIATDPDEVLLLMSACKQQSNKCLPVRSPVMSSLNTSVVFGFLNFILWAGNIWFVFKETGWHSSGQRHAADTMEKQSSGYNQGGYNQDSYGPAGGYNQPGSYGQVGDYGQPQSYGQSGPTSFANQI

SEQ ID NO: 62 - protein, 357 aa, Homo sapiens [sequence omitted]

SEQ ID NO: 63 - protein, 354 aa, Gallus gallus
MALLRALLGLLACTPRPSAAYFGLTGNEALTILPLTSEMEEAAVKAHYKVCDRLKLEKKQRRMCRRDPGGAETLMEAISMSALECQYQFRFERWNCTLEGRYRASLLKRGFKETAFLYAISSAGLTHAMAKACSAGRMERCTCDEAPDLENREAWQWGGCGDNLKYSNKFVKEFLGRKPNKDLRARVDFHNNLVGMKVIKAGVETTCKCHGVSGSCTVRTCWRQLSPFHEIGKQLKQKYETSLKVGSTTNEATGEGDISPPKKSIPGHSDQIPRTTDLVYIDDSPSFCLMSRYSPGTSGRKCYKDKNCDSICCGRGHNTQSRVVTRPCQCQVRWCCYVECKQCTQREEVYTCKD

SEQ ID NO: 64 - protein, 365 aa, Homo sapiens
MLDGSPLARWLAAAFGLTLLLAALRPSAAYFGLTGSEPLTILPLTLEPEAAAQAHYKACDRLKLERKQRRMCRRDPGVAETLVEAVSMSALECQFQFRFERWNCTLEGRYRASLLKRGFKETAFLYAISSAGLTHALAKACSAGRMERCTCDEAPDLENREAWQWGGCGDNLKYSSKFVKEFLGRRSSKDLRARVDFHNNLVGVKVIKAGVETTCKCHGVSGSCTVRTCWRQLAPFHEVGKHLKHKYETALKVGSTTNEAAGEAGAISPPRGRASGAGGSDPLPRTPELVHLDDSPSFCLAGRFSPGTAGRRCHREKNCESICCGRGHNTQSRVVTRPCQCQVRWCCYVECRQCTQREEVYTCKG

SEQ ID NO: 65 - protein, 371 aa, Xenopus laevis
MRILTFLLGLKTLWVLAFSSLSNTIAVNNSGKWWGIVNVASAGNVLPGSDARPVPLVLDPSLQLLSRQKRLIRQNPGILQSITRGLHSAIRECKWHFRNRRWNCPTGTGNQVFGKIINRGCRETAFVFAITSAGVTHSVARSCSEGSIESCSCDYRRRGPGGPDWHWGGCSDNIEFGRFIGREFVDSSERGRDLKYLVNLHNNQAGRLTVLTEMRQECKCHGMSGSCSLRTCWMRLPPFRSVGDALKDRFDGASKVTYSNNGSNRWGSRSDPPHLEPENPTHALPSSQDLVYFEKSPNFCSPSEKNGTPGTTGRICNSTSLGLDGCELLCCGRGYRSLAEKVTERCHCTFNWCCHVTCLNCTSSQIVHECL

SEQ ID NO: 66 - protein, 120 aa, Homo sapiens
SGSCAVRTCWKQLSPFRETGQVLKLRYDSAVKVSSATNEALGRLELWAPARQGSLTKGLAPRSGDLVYMEDSPSFCRPSKYSPGTAGRVCSREASCSSLCCGRGYDTQSRLVAFSCHCQV

SEQ ID NO: 67 - protein, 352 aa, Mus musculus
MAPLGYLLVLCSLKQALGSYPIWWSLAVGPQYSSLSTQPILCASIPGLVPKQLRFCRNYVEIMPSVAEGVKAGIQECQHQFRGRRWNCTTVSNSLAIFGPVLDKATRESAFVHAIASAGVAFAVTRSCAEGSAAICGCSSRLQGSPGEGWKWGGCSEDIEFGGMVSREFADARENRPDARSAMNRHNNEAGRQAIASHMHLKCKCHGLSGSCEVKTCWWSQPDFRTIGDFLKDKYDSASEMVVEKHRESRGWVETLRPRYTYFKVPTERDLVYYEASPNFCEPNPETGSFGTRDRTCNVSSHGIDGCDLLCCGRGHNARTERRREKCHCVFHWCCYVSCQECTRVYDVHTCK

SEQ ID NO: 68 - protein, 376 aa, Gallus gallus
MKSFCSEVVAKSRLGLKQWGWCGWTPMGSAWKKWISEQRSSLELWDVGSLAIGHQYSSLGTQPILCGSIPGLVPKQLRFCRNYVEIMPSVAEGVKIGIQECQHQFRGRRWNCTTVNDSLAIFGPVLDKATRESAFVHAIASAGVAFAVTRSCAEGSATICGCDTRHKGSPGEGWKWGGCSEDVEFGSMVSREFADARENRPDARSAMNRHNNEAGRTSIIELMHLKCKCHGLSGSCEVKTCWWSQPDFRVIGDYLKDKYDSASEMVVEKHRESRGWVETLRPKYNFFKAPTEKDLVYYENSPNFCEPNPETGSFGTRDRICNVTSHGIDGCDLLCCGRGHNTRTEKRKEKCHCIFHWCCYVRCQECIRVYDVHTCK

SEQ ID NO: 69 - protein, 689 aa, Homo sapiens
MADLEAVLADVSYLMAMEKSKATPAARASKKILLPEPSIRSVMQKYLEDRGEVTFEKIFSQKLGYLLFRDFCLNHLEEARPLVEFYEEIKKYEKLETEEERVARSREIFDSYIMKELLACSHPFSKSATEHVQGHLGKKQVPPDLFQPYIEEICQNLRGDVFQKFIESDKFTRFCQWKNVELNIHLTMNDFSVHRIIGRGGFGEVYGCRKRDTGKMYAMKCLDKKRIKMKQGETLALNERIMLSLVSTGDCPFIVCMSYAFHTPDKLSFILDLMNGGDLHYHLSQHGVFSEADMRFYAAEIILGLEHMHNRFVVYRDLKPANILLDEHGHVRISDLGLACDFSKKKPHASVGTHGYMAPEVLQKGVAYDSSADWFSLGCMLFKLLRGHSPFRQHKTKDKHEIDRMTLTMAVELPDSFSPELHSLLEGLLQRDVNRRLGCLGRGAQEVKESPFFRSLDWQMVFLQKYPPPLIPPRGEVNAADAFDIGSFDEEDTKGIKLLDSDQELYRNFPLTISERWQQEVAETVFDTINAETDRLEARKKAKNKQLGHEEDYALGKDCIMHGYMSKMGNPFLTQWQRRYFYLFPNRLEWRGEGEAPQSLLTMEEIQSVEETQIKERKCLLLKIRGGKQFILQCDSDPELVQWKKELRDAYREAQQLVQRVPKMKNKPRSPVVELSKVPLVQRGSANGL

SEQ ID NO: 70 - protein, 689 aa, Homo sapiens
MADLEAVLADVSYLMAMEKSKATPAARASKKILLPEPSIRSVMQKYLEDRGEVTFEKIFSQKLGYLLFRDFCLNHLEEARPLVEFYEEIKKYEKLETEEERVARSREIFDSYIMKELLACSHPFSKSATEHVQGHLGKKQVPPDLFQPYIEEICQNLRGDVFQKFIESDKFTRFCQWKNVELNIHLTMNDFSVHRIIGRGGFGEVYGCRKRDTGKMYAMKCLDKKRIKMKQGETLALNERIMLSLVSTGDCPFIVCMSYAFHTPDKLSFILDLMNGGDLHYHLSQHGVFSEADMRFYAAEIILGLEHMHNRFVVYRDLKPANILLDEHGHVRISDLGLACDFSKKKPHASVGTHGYMAPEVLQKGVAYDSSADWFSLGCMLFKLLRGHSPFRQHKTKDKHEIDRMTLTMAVELPDSFSPELHSLLEGLLQRDVNRRLGCLGRGAQEVKESPFFRSLDWQMVFLQRYPPPLIPPRGEVNAADAFDIGSFDEEDTKGIKLLDSDQELYRNFPLTISERWQQEVAETVFDTINAETDRLEARKKAKNKQLGHEEDYALGKDCIMHGYMSKMGNPFLTQWQRRYFYLFPNRLEWRGEGEAPQSLLTMEEIQSVEETQIKERKCLLLKIRGGKQFILQCDSDPELVQWKKELRDAYREAQQLVQRVPKMKNKPRSPVVELSKVPLVQRGSANGL

SEQ ID NO: 71 - protein, 687 aa, Mus musculus
DLEAVLADVSYLMAMEKSKATPAARASKKILLPEPSIRSVMQKYLEDRGEVTFEKIFSQKLGYLLFRDFCLNHLEEAKPLVEFYEEIKKYEKLETEEERVVRSREIFDSYIMKELLACSHPFSKNATEHVQGHLVKKQVPPDLFQPYIEEICQNLRGDVFQKFIESDKFTRFCQWKNVELNIHLTMNDFSVHRIIGRGGFGEVYGCRKADTGKMYAMKCLDKKRIKMKQGETLALNERIMLSLVSTGDCPFIVCMSYAFHTPDKLSFILDLMNGGDLHYHLSQHGVFSEADMRFYAAEIILGLEHMHNRFVVYRDLKPANILLDEHGHVRISDLGLACDFSKKRPHASVGTHGYMAPEVLQKGVAYDSSADWFSLGCMLFKLLRGHSPFRQHKTKDKHEIDRMTLTMAVELPDSFSPELRSLLEGLLQRDVNRRLGCLGRGAQEVKESPFFRSLDWQMVFLQKYPPPLIPPRGEVNAADAFDIGSFDEEDTKGIKLLDSDQELYRNFPLTISERWQQEVAETVFDTINAETDRLEARKKAKNKQLGHEEDYALGKDCIVHGYMSKMGNPFLTQWQRRYFYLFPNRLEWRGEGEAPQSLLTMEEIQSVEETQIKERKCLLLKIRGGKQFVLQCDSDPELVQWKKELRDAYREAQQLVQRVPKMKNKPRSPVVELSKVPLIQRGSANGL

SEQ ID NO: 72 - protein, 689 aa, Rattus norvegicus
MADLEAVLADVSYLMAMEKSKATPAARASKKILLPEPSIRSVMQKYLEDRGEVTFEKIFSQKLGYLLFRDFYLNHLEEAKPLVEFYEEIEKYEKLETEEERVVRSREIFDSYIMKELLACSHPFSKNATEHVQGHLVKKQVPPDLFQPYIEEICQNLRGDVFHKFIESDKFTRFCQWKNVELNIHLTMNDFSVHRIIGRGGFGEVYGCRKADTGKMYAMKCLDKKRIKMKQGETLALNERIMLSLVSTGDCPFIVCMSYAFHTPDKLSFILDLMNGGDLHYHLSQHGVFSEADMRFYAAEIILGLEHMHNRFVVYRDLKPANILLDEHGHVRISDLGLACDFSKKKPHASVGTHGYMAPEVLQKGVAYDSSADWFSLGCMLFKLLRGHSPFRQHKTKDKHEIDRMTLTMAVELPDSFSPELRSLLEGLLQRDVNRRLGCLGRGAQEIKESPFFRSLDWQMVFLQKYPPPLIPPRGEVNAADAFDIGSFDEEDTKGIKLLDSDQELYRNFPLTISERWQQEVAETVFDTINAETDRLEARKKAKNKQLGHEEDYALGKDCIMHGYMSKMGNPFLTQWQRRYFYLFPNRLEWRGEDEAPQSLLTMEEIQSVEETQIKERKCLLLKIRGGKQFVLQCDSDPELVQWKKELRDAYREAQQLVQRVPKMKNKPRSPVVELSKVPLIQRGSANGL

SEQ ID NO: 73 - protein, 1062 aa, Homo sapiens
MAAAPFLKHWRTTFERVEKFVSPIYFTDCNLRGRLFGASCPVAVLSSFLTPERLPYQEAVQRDFRPAQVGDSFGPTWWTCWFRVELTIPEAWVGQEVHLCWESDGEGLVWRDGEPVQGLTKEGEKTSYVLTDRLGERDPRSLTLYVEVACNGLLGAGKGSMIAAPDPEKIFQLSRAELAVFHRDVHMLLVDLELLLGIAKGLGKDNQRSFQALYTANQMVNVCDPAQPETFPVAQALASRFFGQHGGESQHTIHATGHCHIDTAWLWPFKETVRKCARSWVTALQLMERNPEFIFACSQAQQLEWVKSRYPGLYSRIQEFACRGQFVPVGGTWVEMDGNLPSGEAMVRQFLQGQNFFLQEFGKMCSEFWLPDTFGYSAQLPQIMHGCGIRRFLTQKLSWNLVNSFPHHTFFWEGLDGSRVLVHFPPGDSYGMQGSVEEVLKTVANNRDKGRANHSAFLFGFGDGGGGPTQTMLDRLKRLSNTDGLPRVQLSSPRQLFSALESDSEQLCTWVGELFLELHNGTYTTHAQIKKGNRECERILHDVELLSSLALARSAQFLYPAAQLQHLWRLLLLNQFHDVVTGSCIQMVAEEAMCHYEDIRSHGNTLLSAAAAALCAGEPGPEGLLIVNTLPWKRIEVMALPKPGGAHSLALVTVPSMGYAPVPPPTSLQPLLPQQPVFVVQETDGSVTLDNGIIRVKLDPTGRLTSLVLVASGREAIAEGAVGNQFVLFDDVPLYWDAWDVMDYHLETRKPVLGQAGTLAVGTEGGLRGSAWFLLQISPNSRLSQEVVLDVGCPYVRFHTEVHWHEAHKFLKVEFPARVRSSQATYEIQFGHLQRPTHYNTSWDWARFEVWAHRWMDLSEHGFGLALLNDCKYGASVRGSILSLSLLRAPKAPDATADTGRHEFTYALMPHKGSFQDAGVIQAAYSLNFPLLALPAPSPAPATSWSAFSVSSPAVVLETVKQAESSPQRRSLVLRLYEAHGSHVDCWLHLSLPVQEAILCDLLERPDPAGHLTSGQPPEAHLFSLPSAVPVARASASATLSPWGWGFVCRRLWGLLISASPA

SEQ ID NO: 74 - protein, 1040 aa, Homo sapiens
MAAAPALKHWRTTLERVEKFVSPLYFTDCNLRGRLFGASCPVAVLSSFLTPERLPYQEAVQRDFRPAQVGDSFGPTWWTCWFRVELTIPEAWVGQEVHLCWESDGEGLVWRDGEPVQGLTKEGEKTSYVLTDRLGERDPRSLTLYVEVACNGLLGAGKGSMIAAPDPEKMFQLSRAELAVFHRDVHMLLVDLELLLGIAKGLGKDNQRSFQALYTANQMVNVCDPAQPETFPVAQALASRFFGQHGGESQHTIHATGHCHIDTAWLWPFKETVRKCARSWVTALQLMERNPEFIFACSQAQQLEWVKSRYPGLYSRIQEFACRGQFVPVGGTWVEMDGNLPSGEAMVRQFLQGQNFFLQEFGKMCSEFWLPDTFGYSAQLPQIMHGCGIRRFLTQKLSWNLVNSFPHHTFFWEGLDGSRVLVHFPPGDSYGMQGSVEEVLKTVANNRDKGRANHSAFLFGFGDGGGGPTQTMLDRLKRLSNTDGLPRVQLSSPRQLFSALESDSEQLCTWVGELFLELHNGTYTTHAQIKKGNRECERILHDVELLSSLALARSAQFLYPAAQLQHLWRLLLLNQFHDVVTGSCIQMVAEEAMCHYEDIRSHGNTLLSAAAAALCAGEPGPEGLLIVNTLPWKRIEVMALPKPGGAHSLALVTVPSMGYAPVPPPTSLQPLLPQQPVFVVQETDGSVTLDNGIIRVKLDPTGRLTSLVLVASGREAIAEGAVGNQFVLFDDVPLYWDAWDVMDYHLETRKPVLGQAGTLAVGTEGGLRGSAWFLLQISPNSRLSQEVVLDVGCPYVRFHTEVHWHEAHKFLKVEFPARVRSSQATYEIQFGHLQRPTHYNTSWDWARFEVWAHRWMDLSEHGFGLALLNDCKYGASVRGSILSLSLLRAPKAPDATADTGRHEFTYALMPHKGSFQDAGVIQAAYSLNFPLLALPAPSPAPATSWSAFSVSSPAVVLETVKQAESSPQRRSLVLRLYEAHGSHVDCWLHLSLPVQEAILCDLLERPDPAGHLTLRDNRLKLTFSPFQVLSLLLVLQPPPH

SEQ ID NO: 75 - protein, 1039 aa, Homo sapiens
MAAAPFLKHWRTTFERVEKFVSPIYFTDCNLRGRLFGDSCSVTLSSFLTPERLPYEKAVQQNFSPAQVGDSFGPTWWTCWFRVELVIPEVWVGQEVHLCWESDGESLVWRDGEPVQGLTKEGEKTSYVLSERLRASDPRSLTLYVEVACNGLLGAGKGSMIAAPDPEKMFQLSQAKLAVFHRDVHSLLVDLELLLGVAKGLGEDSQRSFQALHTANQMVNICDPAQPETYPAAKALASKFFGQHGGESQHTIHAMGHCHIDTAWLWPFKETVRKCARSWSTAVTLMEQNTDFIFACSQAQQLEWVKSQYPGLHARLQEFACRGQFVPVGGTWVEMDGNLPSGEAMVRQFLQGQNFFLQEFGKMCSEFWLPDTFGYSAQLPQIMQGCGIKRFLTQKLSWNLVNSFPHHTFFWEGLDGSRVLVHFPPGDSYGMQGSVEEVLKTVTNNRDKGRTNHSGFLFGFGDGGGGPTQTMLDRLKRLSNTDGLPRVQLSSPGQLFTALERDSGQLCTWVGELFLELHNGTYTTHAQLKKGNRECEQILHDVEVLSSLALARSAQFLYPAAQLQHLWRLLLLNQFHDVVTGSCIQLVAEDAMNYYEDIRSHGNPLLSAAAAALCAGEPGPKGLLIINTLPWKRTEVLALPKPCGAHSLALVTVPSIGYAPAPTPTSLQPLLPQQPVFVMQETDGSVTLDNGIIRVRLDPTGCLTSLVLVASGREAIAEGALGNQFVLFDDVPLYWDAWDVMDYHLETRKPVLGQAGTLAVGTEGGLRGSAWFLLQISPNSRLSQEVVLDVGCPYVRFHTEVHWHEAHKFLKVEFPARIRSPQATYEIQFGHLQRPTHNNTSWDWARYEVWAHRWIDLSECDFGLALLNNCKYGASVRGNVLSLSLLRAPKAPDATADMGRHEFTYALMPHKGSFQEAGVIHAAYNLNFPLLALPAPGPAPDTTWSAFSVSSPAVVLETIKQAERCHQHRTLVLRLYEAHGSHVDCWLHTSLPVQEATLCDLLEQRDPTGHLSLQDNRLKLTFSPFQVRSLLLVLQSPPN

SEQ ID NO: 76 - protein, 408 aa, Rattus norvegicus
  misc_feature (274)..(274): Wherein Xaa may be any naturally occurring amino acid
  misc_feature (341)..(341): Wherein Xaa may be any naturally occurring amino acid
MAAAPFLKHWTRTTFERVEKFEVSPIYFTDCNALRGRLFGDSCPVTLSSFLTPTERLPYEKAVQEDITTRQNFSPAQVGDNSFGPTWWTCWPFRVELVIPEVWVGKEVHLCWAESDGESLVWRDDGEPVQGLTKSNNEFEGEKTSYVLSTERLHAADPRSRLTLYVEVACNGLLGAGKGSMDIAAPDPEKMFTQLSQAKLAVFFNTNAHRDVHNLLVDSLELLLGVAKGTLGEDNQRSFQAALYTANQMVNICDPAQPETYPAAEALASKFTAXRDFGQRGGESQHTIHATGHCHIIDTAWLWPFKETVRKCARSWSTTAVKLMERNTEFTFACSQAQTAXSTQLEWVKNQYPSGLYAQLQEFANCRGQFVPVGGLTWVEMDGNLPLSGEAMVRQFLRQGQNFFLQEF

SEQ ID NO: 77 - protein, 258 aa, Homo sapiens
MLLVLVVLIPVLVSSGGPEGHYEMLGTCRMVCDPYPARGPGAGARTDGGDALSEQSGAPPPSTLVQGPQGKPGRTGKPGPPGPPGDPGPPGPVGPPGEKGEPGKPGPPGLPGAGGSGAISTATYTTVPRVAFYAGLKNPHEGYEVLKFDDVVTNLGNNYDAASGKFTCNIPGTYFFTYHVLMRGGDGTSMWADLCKNGQVRASAIAQDADQNYDYASNSVILHLDAGDEVFIKLDGGKAHGGNSNKYSTFSGFIIYSD

SEQ ID NO: 78 - protein, 258 aa, Mus musculus
MLLVLVVLIPVLVSSGGPDGHYEMLGTCRMVCDPYPARGPGAGARSDGGDAVSEQSGAPPPSTLVQGPQGKPGRTGKPGPPGPPGDRGPPGPVGPPGEKGEPGKPGPPGLPGSGGSGAISTATYTTVPRVAFYAGLKNPHEGYEVLKFDDVVTNLGNNYDAASGKFTCNIPGTYFFTYHVLMRGGDGTSMWADLCKNGQVRASAIAQDADQNYDYASNSVILHLDAGDEVFIKLDGGKAHGGNSNKYSTFSGFIIYSD

SEQ ID NO: 79 - protein, 258 aa, Mus musculus; identical to SEQ ID NO: 78

SEQ ID NO: 80 - protein, 251 aa, Homo sapiens
MKIPWGSIPVLMLLLLLGLIDISQAQLSCTGPPAIPGIPGIPGTPGPDGQPGTPGIKGEKGLPGLAGDHGEFGEKGDPGIPGNPGKVGPKGPMGPKGGPGAPGAPGPKGESGDYKATQKIAFSATRTINVPLRRDQTIRFDHVITNMNNNYEPRSGKFTCKVPGLYYFTYHASSRGNLCVNLMRGRERAQKVVTFCDYAYNTFQVTTGGMVLKLEQGENVFLQATDKNSLLGMEGANSIFSGFLLFPDMEA

SEQ ID NO: 81 - protein, 1894 aa, Mus musculus
MPLPPLSSRTLLLLLLLLLRGVWIAISSPPAGLGPQPAFRTFVASDWGLTHLVVHEQTGEVYVGAVNRIYKLSGNLTLLRAHVTGPVEDNEKCYPPPSVQSCPHGLGSTDNVNKLLLLDYAANRLLACGSASQGICQFLRLDDLFKLGEPHHRKEHYLSSVREAGSMAGVLIAGPPGQGQAKLFVGTPIDGKSEYFPTLSSRRLMANEEDADMFGFVYQDEFVSSQLKIPSDTLSKFPAFDIYYVYSFRSEQFVYYLTLQLDTQLTSPDAAGEHFFTSKIVRLCVNDPKFYSYVEFPIGCEQAGVEYRLVQDAYLSRPGQALAKQLGLAEDEEVLFTVFAQGQKNRVKPPKESALCLFTLRAIKEKIKERIQSCYRGEGKLSLPWLLNKELGCINSPLQIDDDFCGQDFNQPLGGTVTIEGTPLFVDKEDGLTAVAAYDYQGRTVVFAGTRSGRIRKILVDLANPSGRPALAYESVVAQEGNPILRDLVLSPNRQYLYAMTEKQVTQVPVESCVQYTSCELCLGSRDPHCGWCVLHSICSRQDACERAEEPQRFASDLLQCVQLTVQPRNVSVTMSQVPLVLQAWNVPDLSAGVNCSFEDFTETESILEDGRIHCHSPSAREVAPITQGQGDQRVVKLYLKSKETGKKFASVDFVFYNCSVHQSCLACVNGSFPCHWCKYRHVCTNNAADCAFLEGRVNMSEDCPQILPSTHIYVPVGVVKPITLAARNLPQPQSGQRGYECLFHIPGSPARVTALRFNSSSLQCQNSSYSYEGNDVSDLPVNLSVVWNGNFVIDNPQNIQAHLYKCPALRQSCGLCLKADPRFECGWCVAERRCSLRHHCPADSPASWMHAHHGSSRCTDPKILKLSPETGPRQGGTRLTITGENLGLRFEDVRLGVHVGKVLCSPVESEYISAEQIVCEIGDASTLRAHDALVEVCVRDCSLHYRALSPKRFTFVTPTFYRVSPSRGPLSGGTWIGIEGSHLNAGSDVAVSIGGRPCSFSWRNSREIRCLTPPGHTPGSAPIVININRAQLSNPEVKYNYTEDPTILRIDPEWSINSGGTLLTVTGTNLATVREPRIRAKYGGIERENSCMVYNDTTMVCRAPSIDNPKRSPPELGERPDEIGFIMDNVRTLLVLNSSSFLYYPDPVLEPLSPTGLLELKPSSPLILKGRNLLPPAPGNSRLNYTVLIGSTPCILTVSETQLLCEAPNLTGQHKVTVRAGGFEFSPGMLQVYSDSLLTLPAIVGIGGGGGLLLLVIVAVLIAYKRKSRDADRTLKRLQLQMDNLESRVALECKEAFAELQTDIHELTSDLDGAGIPFLDYRTYAMRVLFPGIEDHPVLKEMEVQANVEKSLTLFGQLLTKKHFLLTFIRTLEAQRSFSMRDRGNVASLIMTALQGEMEYATGVLKQLLSDLIEKNLESKNHPKLLLRRTESVAEKMLTNWFTFLLYKFLKECAGEPLFMLYCAIKQQMEKGPIDAITGEARYSLSEDKLIRQQIDYKTLTLNCVNPEHENAPEVPVKGLNCDTVTQVKEKLLDAVYKGVPYSQRPKAGDMDLEWRQGRMARIILQDEDVTTKIDNDWKRLNTLAHYQVTDGSSVALVPKQTSAYNISNSSTFTKSLSRYESMLRTASSPDSLRSRTPMITPDLESGTKLWHLVKNHDHLDQREGDRGSKMVSEIYLTRLLATKGTLQKFVDDLFETIFSTAHRGSALPLAIKYMFDFLDEQADKHQIHDSDVRHTWKSNCLPLRFWVNVIKNPQFVFDIHKNSITDACLSVVAQTFMDSCSTSEHKLGKDSPSNKLLYAKDIPNYKSWVERYYADIAKMPAISDQDMSAYLAEQSRLHLSQFNSMSALHEIYSYIAKYKDEILVALEKDEQARRQRLRSKLEQVVDTMALSS

SEQ ID NO: 82 - protein, 1754 aa, Homo sapiens
  misc_feature (78)..(78): Wherein Xaa may be any naturally occurring amino acid
  misc_feature (123)..(123): Wherein Xaa may be any naturally occurring amino acid
  misc_feature (620)..(620): Wherein Xaa may be any naturally occurring amino acid
  misc_feature (1474)..(1474): Wherein Xaa may be any naturally occurring amino acid
GMWAEAGLPRAGGGSQPPFRTFSGSDWGLTHLLVHEQTGEVYVGAVNRIYKLSGNLTLLRAHVTGPVEDNEKCYPPPXVQSCPHGLGNTDNVNKLLLLDYAANRLLACGSASQGICQSLRLDXLFKLGEPHHRKEHYLSSVQEAGSMAGVLIAGPPGQGQAKLFVGTPIDGKSEYFPTLSSRRLMANEEDADMFGFVYQDEFVSSQLKIPSDTLSKFPAFDIYYVYSFRSEQFVYYLTLQLDTQLTSPDAAGEHFFTSKIVRLCVDDPKFYSYVEFPIGCEQAGVEYRLVQDAYLSRPGRALAHQLGLAEDEDVLFTVFAQGQKNRVKPPKESALCLFTLRAIKEKIKERIQSCYRGEGKLSLPWLLNKELGCINSPLQIDDDFRGQDFNQPLGGTVTIEGTPLFVDKDDGLTAVAAYDYRGRTVVFAGTRSGRIRKILVDLSNPGGRPALAYESVVAQEGSPILRDLVLSPNHQYLYAMTEKQVTRVPVESCVQYTSCELCLGSRDPHCGWCVLHSICSRRDACERADEPQRFAADLLQCVQLTVQPRNVSVTMSQVPLVLQAWNVPDLSAGVNCSFEDFTESESVLEDGRIHCRSPSAREVAPITRGQGDQRVVKLYXKSKETGKKFASVDFVFYNCSVHQSCLSCVNGSFPCHWCKYRHVCTHNVADCAFLEGRVNVSEDCPQILPSTQIYVPVGVVKPITLAARNLPQPQSGQRGYECLFHIPGSPARVTALRFNSSSLQCQNSSYSYEGNDVSDLPVNLSVVWNGNFVIDNPQNIQAHLYKCPALRESCGLCLKADPRFECGWCVAERRCSLRHHCAADTPASWMHARHGSSRCTDPKILKLSPETGPRQGGTRLTITGENLGLRFEDVRLGVRVGKVLCSPVESEYISAEQIVCEIGDASSVRAHDALVEVCVRDCSPHYRALSPKRFTFVTPTFYRVSPSRGPLSGGTWIGIEGSHLNAGSDVAVSVGGRPCSFSWRNSREIRCLTPPGQSPGSAPIIININRAQLTNPEVKYNYTEDPTILRIDPEWSINSGGTLLTVTGTNLATVREPRIRAKYGGIERENGCLVYNDTTMVCRAPSVANPVRSPPELGERPDELGFVMDNVRSLLVLNSTSFLYYPDPVLEPLSPTGLLELKPSSPLILKGRNLLPPAPGNSRLNYTVLIGSTPCTLTVSETQLLCEAPNLTGQHKVTVRAGGFEFSPGTLQVYSDSLLTLPAIVGIGGGGGLLLLVIVAVLIAYKRKSRDADRTLKRLQLQMDNLESRVALECKEAFAELQTDIHELTNDLDGAGIPFLDYRTYAMRVLFPGIEDHPVLKEMEVQANVEKSLTLFGQLLTKKHFLLTFIRTLEAQRSFSMRDRGNVASLIMTALQGEMEYATGVLKQLLSDLIEKNLESKNHPKLLLRRTESVAEKMLTNWFTFLLYKFLKECAGEPLFMLYCAIKQQMEKGPIDAITGEARYSLSEDKLIRXQIDYKTLTLNCVNPENENAPEVPVKGLDCDTVTQAKEKLLDAAYKGVPYSQRPKAADMDLEWRQGRMARIILQDEDVTTKIDNDWKRLNTLAHYQVTDGSSVALVPKQTSAYNISNSSTFTKSLSRYESMLRTASSPDSLRSRTPMITPDLESGTKLWHLVKNHDHLDQREGDRGSKMVSEIYLTRLLATKGTLQKFVDDLFETIFSTAHRGSALPLAIKYMFDFLDEQADKHQIHDADVRHTWKSNCLPLRFWVNVIKNPQFVFDIHKNSITDACLSVV

SEQ ID NO: 83 - protein, 160 aa, Xenopus laevis
MLLHAERPLPFHLWTFLVLLGSWIATGDGSPKDFRTFTGSDWSLTHLVVHNKTGEVYVGAINRIYKLSNNLTLLRTHVTGPVEDNEKCYPPPSVQSCPHGLITTNNVNKLLLIDYSDNRLIACGSASQGICQFLRLDDLFKLGEPHHRKEHYLSSVNESG

SEQ ID NO: 84 - protein, 1871 aa, Homo sapiens
  misc_feature (380)..(380): Wherein Xaa may be any naturally occurring amino acid
MPSVCLLLLLFLAVGGALGNRPFRAFVVTDTTLTHLAVHRVTGEVFVGAVNRVFKLAPNLTELRAHVTGPVEDNARCYPPPSMRVCAHRLAPVDNINKLLLIDYAARRLVACGSIWQGICQFLRLDDLFKLGEPHHRKEHYLSGAQEPDSMAGVIVEQGQGPSKLFVGTAVDGKSEYFPTLSSRKLISDEDSADMFSLVYQDEFVSSQIKIPSDTLSLYPALDIYYIYGFVSASFVYFLTLQLDTQQTLLDTAGEKFFTSKIVRMCAGDSEFYSYVEFPIGCSWRGVEYRLVQSAHLAKPGLLLAQALGVPADEDVLFTIFSQGQKNRASPPRQTILCLFTLSNINAHIRRRIQSCYRGEGTLALPWLLNKELPCINTPXQINGNFCGLVLNQPLGGLHVIEGLPLLADSTDGMASVAAYTYRQHSVVFIGTRSGSLKKVRVDGFQDAHLYETVPVVDGSPILRDLLFSPDHRHIYLLSEKQVSQLPVETCEQYQSCAACLGSGDPHCGWCVLRHRCCREGACLGASAPHGFAEELSKCVQVRVRPNNVSVTSPGVQLTVTLHNVPDLSAGVSCAFEAAAENEAVLLPSGELLCPSPSLQELRALTRGHGATRTVRLQLLSKETGVRFAGADFVFYNCSVLQSCMSCVGSPYPCHWCKYRHTCTSRPHECSFQEGRVHSPEGCPEILPSGDLLIPVGVMQPLTLRAKNLPQPQSGQKNYECVVRVQGRQQRVPAVRFNSSSVQCQNASYSYEGDEHGDTELDFSVVWDGDFPIDKPPSFRALLYKCWAQRPSCGLCLKADPRFNCGWCISEHRCQLRTHCPAPKTNWMHLSQKGTRCSHPRITQIHPLVGPKEGGTRVTIVGENLGLLSREVGLRVAGVRCNSIPAEYISAERIVCEMEESLVPSPPPGPVELCVGDCSADFRTQSEQVYSFVTPTFDQVSPSRGPASGGTRLTISGSSLDAGSRVTVTVRDSECQFVRRDAKAIVCISPLSTLGPSQAPITLAIDRANISSPGLIYTYTQDPTVTRLEPTWSIINGSTAITVSGTHLLTVQEPRVRAKYRGIETTNTCQVINDTAMLCKAPGIFLGRPQPRAQGEHPDEFGFLLDHVQTARSLNRSSFTYYPDPSFEPLGPSGVLDVKPGSHVVLKGKNLIPAAAGSSRLNYTVLIGGQPCSLTVSDTQLLCDSPSQTGRQPVMVLVGGLEFWLGTLHISAERALTLPAMMGLAAGGGLLLLAITAVLVAYKRKTQDADRTLKRLQLQMDNLESRVALECKEAFAELQTDINELTNHMDEVQIPFLDYRTYAVRVLFPGIEAHPVLKELDTPPNVEKALRLFGQLLHSRAFVLTFIHTLEAQSSFSMRDRGTVASLTMVALQSRLDYATGLLKQLLADLIEKNLESKNHPKLLLRRTESVAEKMLTNWFTFLLHKFLKECAGEPLFLLYCAIKQQMEKGPIDAITGEARYSLSEDKLIRQQIDYKTLTLHCVCPENEGSAQVPVKVLNCDSITQAKDKLLDTVYKGIPYSQRPKAEDMDLEWRQGRMTRIILQDEDVTTKIECDWKRLNSLAHYQVTDGSLVALVPKQVSAYNMANSFTFTRSLSRYESLLRTASSPDSLRSRAPMITPDQETGTKLWHLVKNHDHADHREGDRGSKMVSEIYLTRLLATKGTLQKFVDDLFETVFSTAHRGSALPLAIKYMFDFLDEQADQRQISDPDVRHTWKSNCLPLRFWVNVIKNPQFVFDIHKNSITDACLSVVAQTFMDSCSTSEHRLGKDSPSNKLLYAKDIPNYKSWVERYYRDIAKMASISDQDMDAYLVEQSRLHASDFSVLSALNELYFYVTKYRQEILTALDRDASCRKHKLRQKLEQIISLVSSDS

SEQ ID NO: 85 - protein, 104 aa, Artificial Sequence
  Description of Artifical Sequence:  Domain
PSFLVSGTFDARGGRLRGPRTGVRLIIPPGAIPQGTRYTCYLVVHDKLSTPPPLEEGETLLSPVVECGPHGALFLRPVILEVPHCASLRPRDWEIVLLRSENGG

SEQ ID NO: 86 - protein, 104 aa, Artificial Sequence
  Description of Artifical Sequence:  Domain
SGFLVSGTFDARGGRLRGPRTGVRLIIPPGAIPQGTRYTCYLVVHDKLSTPPPLEEGETLLSPVVECGPHGALFLRPVILEVPHCASLRPRDWELVLLRSENGG

SEQ ID NO: 87 - protein, 95 aa, Artificial Sequence
  Description of Artifical Sequence:  Domain
PPGAASLTELTREKLAKLLDHDLGDDWRELARKLGLSEADIDQIETESPRDLAEQSYQLLRLWEQREGKNATLGTLLEALRKMGRDDAVELLRSE

SEQ ID NO: 88 - protein, 51 aa, Artificial Sequence
  Description of Artifical Sequence:  Domain
WGEWSEWSPCSVTCGGGVQTRTRCCNPPPNGGGPCTGPDTETRACNEQPCP

SEQ ID NO: 89 - protein, 82 aa, Artificial Sequence
  Description of Artifical Sequence:  Domain
RELCKLLDDPLGRDWRRLARKLGLSEEEIDQIEHENPRLASPTYQLLDLWEQRGGKNATVGTLLEALRKMGRDDAVELLESA

SEQ ID NO: 90 - protein, 44 aa, Artificial Sequence
  Description of Artifical Sequence:  Domain
SPWSEWSPCSVTCGKGIRTRQRTCNSPAGGKPCTGDAQETEACM

SEQ ID NO: 91 - protein, 86 aa, Artificial Sequence
  Description of Artifical Sequence:  Domain
PPSVTVKEGESVTLSCEASGNPPPTVTWYKQGGKLLAESGRFSVSRSGGNSTLTISNVTPEDSGTYTCAATNSSGSASSGTTLTVL

SEQ ID NO: 92 - protein, 55 aa, Artificial Sequence
  Description of Artifical Sequence:  Domain
VTLTCPASGDPVPNITWLKDGKPLPESRVVASGSTLTIKNVSLEDSGLYTCVARN

SEQ ID NO: 93 - protein, 263 aa, Artificial Sequence
  Description of Artifical Sequence:  Domain
GLEEEFEKLQRLTPDDLSCTVAILPENRDKNRYKDVLPYDHTRVKLKPPPGEGSDYINASYIDGPNRPKAYIATQGPLPSTVEDFWRMVWEEKVPVIVMLTELVEKGREKCAQYWPEKEGGSLTYGDITVTLKSVEKVDDYTIRTLEVTNTGGSETRTVTHYHYTNWPDHGVPESPKSLLDLVRAVRKSQSTLRNSGPIVVHCSAGVGRTGTFIAIDILLQQLEAGKEVDIFEIVKELRSQRPGMVQTEEQYIFLYRAILEYL

SEQ ID NO: 94 - protein, 235 aa, Artificial Sequence
  Description of Artifical Sequence:  Domain
NKEKNRYKDVLPYDHTRVKLKPLGDEDSDYINASYVDGYKKPKAYIATQGPLPNTIEDFWRMVWEEKVRVIVMLTELVEKGREKCAQYWPEKEGGSLTYGDFTVTCVSVEKKKDDYTVRTLELTNSGDDETRTVKHYHYTGWPDHGVPESPKSILDLLRKVRKSKGTPDDGPIVVHCSAGIGRTGTFIAIDILLQQLEKEGVVDVFDTVKKLRSQRPGMVQTEEQYIFIYDAILE

SEQ ID NO: 95 - protein, 105 aa, Artificial Sequence
  Description of Artifical Sequence:  Domain
TVKHYHYTGWPDHGVPESPDSILEFLRAVKKSLNKSANNGPVVVHCSAGVGRTGTFVAIDILLQQLEAGTGEVDIFDIVKELRSQRPGAVQTLEQYLFLYRALLE

SEQ ID NO: 96 - protein, 86 aa, Artificial Sequence
  Description of Artifical Sequence:  Domain
PSAPTNLTVTDVTSTSLTLSWSPPPDGNGPITGYEVEYQPVNSGEEWNEITVPGTTTSYTLTGLKPGTEYEVRVQAVNGGGNGPPS

SEQ ID NO: 97 - protein, 80 aa, Artificial Sequence
  Description of Artifical Sequence:  Domain
PSPPSNLRVTDVTSTSVTLSWEPPPDDITGYIVGYRVEYREEGEWKEVNVTPSSTTSYTLTGLKPGTEYEFRVRAVNGEA

SEQ ID NO: 98 - protein, 255 aa, Artificial Sequence
  Description of Artifical Sequence:  Domain
ELLEVLGKGAFGKVYLARDKKTGKLVAIKVIKKEKLKKKKRERILREIKILKKLDHPNIVKLYDVFEDDDKLYLVMEYCEGGDLFDLLKKRGRLSEDEARFYARQILSALEYLHSQGIIHRDLKPENILLDSDGHVKLADFGLAKQLDSGGTLLTTFVGTPEYMAPEVLLGKGYGKAVDIWSLGVILYELLTGKPPFPGDDQLLALFKKIGKPPPPFPPPEWKISPEAKDLIKKLLVKDPEKRLTAEEALEHPFF

SEQ ID NO: 99 - protein, 256 aa, Artificial Sequence
  Description of Artifical Sequence:  Domain
YELGEKLGSGAFGKVYKGKHKDTGEIVAIKILKKRSLSEKKKRFLREIQILRRLSHPNIVRLLGVFEEDDHLYLVMEYMEGGDLFDYLRRNGLLLSEKEAKKIALQILRGLEYLHSRGIVHRDLKPENILLDENGTVKIADFGLARKLESSSYEKLTTFVGTPEYMAPEVLEGRGYSSKVDVWSLGVILYELLTGKLPFPGIDPLEELFRIKERPRLRLPLPPNCSEELKDLIKKCLNKDPEKRPTAKEILNHPWF

SEQ ID NO: 100 - protein, 257 aa, Artificial Sequence
  Description of Artifical Sequence:  Domain
LTLGKKLGEGAFGEVYKGTLKGKGGVEVEVAVKTLKEDASEQQIEEFLREARLMRKLDHPNIVKLLGVCTEEEPLMIVMEYMEGGDLLDYLRKNRPKELSLSDLLSFALQIARGMEYLESKNFVHRDLAARNCLVGENKTVKIADFGLARDLYDDDYYRKKKSPRLPIRWMAPESLKDGKFTSKSDVWSFGVLLWEIFTLGESPYPGMSNEEVLEYLKKGYRLPQPPNCPDEIYDLMLQCWAEDPEDRPTFSELVER

SEQ ID NO: 101 - protein, 186 aa, Artificial Sequence
  Description of Artifical Sequence:  Domain
GILLYGPPGTGKTLLAKAVAKELGVPFIEISGSELLSKYVGESEKLVRALFSLARKSAPCIIFIDEIDALAPKRGDVGTGDVSSRVVNQLLTEMDGFEKLSNVIVIGATNRPDLLDPALLRPGRFDRRIEVPLPDEEERLEILKIHLKKKPLEKDVDLDEIARRTPGFSGADLAALCREAALRAIR

SEQ ID NO: 102 - protein, 151 aa, Artificial Sequence
  Description of Artifical Sequence:  Domain
PGEVVLIVGPPGSGKTTLARALARELGPDGGGVIYIDGEDLREEALLQLLRLLVLVGEDKLSGSGGQRIRLALALARKLKPDVLILDEITSLLDAEQEALLLLLEELLRLLLLLLKEENVTVIATTNDETDLIPALLRRRFDRRIVLLRIL

SEQ ID NO: 103 - protein, 211 aa, Artificial Sequence
  Description of Artifical Sequence:  Domain
MVIFAPLGFVKVLQWVFAIFAFATCGGYSGELQLSVDCANKTESDLNIDIAFAYPFRLHEVTFEAPTCEGDEKKNIALVGDSSSSAEFFVTVAVFAFLYSLAALATYIFFQNKYRENNKGPLIDFIATAVFAFLWLVGSSAWAKGLSDVKMATDPEEIIKGMHACHQPGNKCKELHDPVMSGLNTSVVFGFLNFILWAGNIWFVFKETGWA

SEQ ID NO: 104 - protein, 306 aa, Artificial Sequence
  Description of Artifical Sequence:  Domain
LSPRQRQLCRRNPDVMASVSEGAQLAIQECQHQFRGRRWNCSTLDRLRVVFGKVLKKGTRETAFVYAISSAGVAHAVTRACSEGELESCGCDYKKGPGGPQGSWQWGGCSDNVEFGIRFSREFVDARERERDARSLMNLHNNEAGRKAVKSHMRRECKCHGVSGSCSMKTCWLSLPDFRAVGDALKDKYDGAIRVEPNKRGMGQGSAPRLVAKNPRFKPPTRSDLVYLEDSPDYCERDRSTGSLGTQGRVCNKTSKGLDGCELLCCGRGYNTQQVERTEKCNCKFHWCCYVKCEECQEVVEVHTCK

SEQ ID NO: 105 - protein, 300 aa, Artificial Sequence
  Description of Artifical Sequence:  Domain
LSRRQRQLCRANPDVMASVAEGAQEGIEECQHQFRFRRWNCSTAGLASIFGKVLRQGTRETAFVYAISSAGVAHAVTRACSQGELDSCGCDYSKRGSGGRGWEWGGCSDNIDFGIGFSREFVDARERRGSDARALMNLHNNEAGRLAVKKTMKRECKCHGVSGSCSVKTCWLQLPEFREIGDYLKEKYDGASEVVLDKRGTRGLVPANRDFKPPTNTDLVYLESSPDFCEKNPKTGSLGTQGRVCNKTSKGLDGCDLLCCGRGYNTEHVEVVERCNCKFHWCCYVKCKQCRERVEKHTCK

SEQ ID NO: 106 - protein, 119 aa, Artificial Sequence
  Description of Artifical Sequence:  Domain
SFEKLLKQPIGRLLFREFLETEFSEENLEFWLAVEEYEKTEDPDKRPDKAREIYDEFISPEAPKPEVNLDSELREHTQDNLLKAPTKDLFEEAQREIYDLMRGDSFPRFLESDYFTRFL

SEQ ID NO: 107 - protein, 119 aa, Artificial Sequence
  Description of Artifical Sequence:  Domain
SLESLLRDPIGRLLFREFLESEFSEENLEFWLAVEEFKKAEDEEERRSKAKEIYDKYLSPNAPKEVNLDSDLREEIEENLKNEEPPPDLFDEAQEEVYELLEKDSYPRFLESDYYLRFL

SEQ ID NO: 108 - protein, 99 aa, Artificial Sequence
  Description of Artifical Sequence:  Domain
IKEGWLLKKSSGGKKSWKKRYFVLFNGVLLYYKSKKKKSSSKPKGSIPLSGCTVREAPDSDSDKKKNCFEIVTPDRKTLLLQAESEEERKEWVEALRKA

SEQ ID NO: 109 - protein, 97 aa, Artificial Sequence
  Description of Artifical Sequence:  Domain
VKEGWLLKKSTVKKKRWKKRYFFLFNDVLIYYKDKKKSYEPKGSIPLSGCSVEDVPDSEFKRPNCFQLRSRDGKETFILQAESEEERQDWIKAIQSA

SEQ ID NO: 110 - protein, 55 aa, Artificial Sequence
  Description of Artifical Sequence:  Domain
RGIDWDKLENKEIEPPFVPKVKSPTDTSNFDPEFTEESPVLTPVDPPLSESDQDE

SEQ ID NO: 111 - protein, 113 aa, Artificial Sequence
  Description of Artifical Sequence:  Domain
VTGGWVMNDEATTHYEDLIDQLTEGHQFLEENFGSDVKPKVGWSIDPFGHSATMPYLLRAQAGFDGFLIQRIHYADKKSFAETKQLEFVWRQSWSLTGSTDLFTHMMPFYSYD

SEQ ID NO: 112 - protein, 125 aa, Artificial Sequence
  Description of Artifical Sequence:  Domain
AFTAIRSTRPPAPGQPVIFDEVLYNQQGHYDPATGKFTCPVPGLYYFNFHVSSKGTNVCVSLMRNGVPVMSFCDEYAKGTYQVASGGAVLQLRQGDRVWLELDDKQTNGLLGGEGVHSVFSGFLL

SEQ ID NO: 113 - protein, 430 aa, Artificial Sequence
  Description of Artifical Sequence:  Domain
LQNLLLDEDNGTLYVGARNRLYVLSLNLISEAEVKTGPVLSSPDCEECVSKGKDPPTDCVNFIRLLLDYNADHLLVCGTNAFQPVCRLINLGNLDRLEVGRESGRGRCPFDPQHNSTAVLVDGELYVGTVADFSGSDPAIYRSLSVRRLKGTSGPSLRTVLYDSRWLNEPNFVYAFESGDFVYFFFRETAVEDENCGKAVVSRVARVCKNDVGGPRSLSKKWTSFLKARLECSVPGEFPFYFNELQAAFLLPAGSESDDVLYGVFSTSSNPIPGSAVCAFSLSDINAVFNEPFKECETGNSQWLPYPRGLVPFPRPGTCPNTPLSSKDLPDDVLNFIKTHPLMDEVVQPLTGRPLFVKTDSNYLLTSIAVDRVRTDGGNYTVLFLGTSDGRILKVVLSRSSSSSESVVLEEISVFDPGSPVSDLVLSPKK

SEQ ID NO: 114 - protein, 431 aa, Artificial Sequence
  Description of Artifical Sequence:  Domain
FVTLLLDEDRGRLYVGARNRVYVLNLEDLSEVLNLKTGWPGSCETCEECNMKGKSPLTECTNFIRVLQAYNDTHLYVCGTNAFQPVCTLINLGDLFSLDVDNEEDGCGDCPYDPLGNTTSVLVQGGELYSGTVIDFSGRDPSIRRLLGSHDGLRTEFHDSKWLNLPNFVDSYPIHYVHSFSDDKVYFFFRETAVEDSNCKTIHSRVARVCKNDPGGRSYLELNKWTTFLKARLNCSIPGEGTPFYFNELQAAFVLPTGADTDPVLYGVFTTSSNSSAGSAVCAFSMSDINQVFEGPFKHQSPNSKWLPYRGKVPQPRPGQCPNASGLNLPDDTLNFIRCHPLMDEVVPPLHNVPLFVGQSGNYRLTSIAVDRVRAGDGQIYTVLFLGTDDGRVLKQVVLSRSSSASYLVVVLEESLVFPDGEPVQRMVISS

SEQ ID NO: 115 - protein, 85 aa, Artificial Sequence
  Description of Artifical Sequence:  Domain
PVITSISPSSGPLSGGTEITITGSNLGSGEDIKVTFGGTECDVVSQEASQIVCKTPPYANGGPQPVTVSLDGGGLSSSPVTFTYV

SEQ ID NO: 116 - protein, 93 aa, Artificial Sequence
  Description of Artifical Sequence:  Domain
DPVITRISPNSGPLSGGTRITLCGKNLDSISVVFVEVGVGEVPCTFLPSDVSQTAIVCKTPPYHNIPGSVPVRVEVGLRNGGVPGEPSPFTYV

SEQ ID NO: 117 - protein, 48 aa, Artificial Sequence
  Description of Artifical Sequence:  Domain
NCSQHTSCGSCLSAPDPGCGWCPSRKRCTRLEECSRGEGWSQSQETCP

SEQ ID NO: 118 - protein, 42 aa, Artificial Sequence
  Description of Artifical Sequence:  Domain
SAYTSCSECLLARDPYCAWCSSQGRCTSGERCDSLRQNWSSG

SEQ ID NO: 119 - DNA, 21 bp, Artificial Sequence
  Description of Artifical Sequence:  Primer/Probe
agactggggccagggagacag

SEQ ID NO: 120 - DNA, 23 bp, Artificial Sequence
  Description of Artifical Sequence:  Primer/Probe
cagaggccaaacatccccatcag

SEQ ID NO: 121 - DNA, 19 bp, Artificial Sequence
  Description of Artifical Sequence:  Primer/Probe
gagacagccctgggggaga

SEQ ID NO: 122 - DNA, 19 bp, Artificial Sequence
  Description of Artifical Sequence:  Primer/Probe
acctgcctcctgccagtcc

SEQ ID NO: 123 - DNA, 21 bp, Artificial Sequence
  Description of Artifical Sequence:  Primer/Probe
catgtcctcgaccgagagcgc

SEQ ID NO: 124 - DNA, 23 bp, Artificial Sequence
  Description of Artifical Sequence:  Primer/Probe
aggtggggggctgcttactgctt

SEQ ID NO: 125 - DNA, 18 bp, Artificial Sequence
  Description of Artifical Sequence:  Primer/Probe
gtcatgaaggggttgctg

SEQ ID NO: 126 - DNA, 19 bp, Artificial Sequence
  Description of Artifical Sequence:  Primer/Probe
ggtcagcccagcccctctg

SEQ ID NO: 127 - DNA, 18 bp, Artificial Sequence
  Description of Artifical Sequence:  Primer/Probe
cggctgctggcatgggtg

SEQ ID NO: 128 - DNA, 24 bp, Artificial Sequence
  Description of Artifical Sequence:  Primer/Probe
ctcctgctctgtttcccccttcat

SEQ ID NO: 129 - DNA, 20 bp, Artificial Sequence
  Description of Artifical Sequence:  Primer/Probe
gccatggtgctgctgctgct

SEQ ID NO: 130 - DNA, 26 bp, Artificial Sequence
  Description of Artifical Sequence:  Primer/Probe
ggctcagtcggggtagatgataaagc

SEQ ID NO: 131 - DNA, 19 bp, Artificial Sequence
  Description of Artifical Sequence:  Primer/Probe
cgggcgcggccgtcggagt

SEQ ID NO: 132 - DNA, 28 bp, Artificial Sequence
  Description of Artifical Sequence:  Primer/Probe
cggggccggctcagtcggggtagatgat

SEQ ID NO: 133 - DNA, 22 bp, Artificial Sequence
  Description of Artifical Sequence:  Primer/Probe
tgacttcgacacagacatcact

SEQ ID NO: 134 - DNA, 24 bp, Artificial Sequence
  Description of Artifical Sequence:  Primer/Probe
actcatctgctgccctgactggtg

SEQ ID NO: 135 - DNA, 21 bp, Artificial Sequence
  Description of Artifical Sequence:  Primer/Probe
ccttgccgtcttaaagttgac

SEQ ID NO: 136 - DNA, 22 bp, Artificial Sequence
  Description of Artifical Sequence:  Primer/Probe
tgacttcgacacagacatcact

SEQ ID NO: 137 - DNA, 24 bp, Artificial Sequence
  Description of Artifical Sequence:  Primer/Probe
actcatctgctgccctgactggtg

SEQ ID NO: 138 - DNA, 21 bp, Artificial Sequence
  Description of Artifical Sequence:  Primer/Probe
ccttgccgtcttaaagttgac

SEQ ID NO: 139 - DNA, 19 bp, Artificial Sequence
  Description of Artifical Sequence:  Primer/Probe
ggctccctggacactctct

SEQ ID NO: 140 - DNA, 26 bp, Artificial Sequence
  Description of Artifical Sequence:  Primer/Probe
ctgtcaccacccagctgggaccttat

SEQ ID NO: 141 - DNA, 20 bp, Artificial Sequence
  Description of Artifical Sequence:  Primer/Probe
tggacagtgggatcttgaag

SEQ ID NO: 142 - DNA, 22 bp, Artificial Sequence
  Description of Artifical Sequence:  Primer/Probe
tgacttcgacacagacatcact

SEQ ID NO: 143 - DNA, 24 bp, Artificial Sequence
  Description of Artifical Sequence:  Primer/Probe
actcatctgctgccctgactggtg

SEQ ID NO: 144 - DNA, 21 bp, Artificial Sequence
  Description of Artifical Sequence:  Primer/Probe
ccttgccgtcttaaagttgac

SEQ ID NO: 145 - DNA, 22 bp, Artificial Sequence
  Description of Artifical Sequence:  Primer/Probe
gaagtgaaagaatgtgcatggt

SEQ ID NO: 146 - DNA, 27 bp, Artificial Sequence
  Description of Artifical Sequence:  Primer/Probe
caccagtgcattctggatctcttatca

SEQ ID NO: 147 - DNA, 22 bp, Artificial Sequence
  Description of Artifical Sequence:  Primer/Probe
tgggctgattacttcccttatt

SEQ ID NO: 148 - DNA, 21 bp, Artificial Sequence
  Description of Artifical Sequence:  Primer/Probe
agatgagtcagtgccgttagc

SEQ ID NO: 149 - DNA, 29 bp, Artificial Sequence
  Description of Artifical Sequence:  Primer/Probe
cctccacaaaatttgactttaatcaactg

SEQ ID NO: 150 - DNA, 22 bp, Artificial Sequence
  Description of Artifical Sequence:  Primer/Probe
tccatttcagccatacaaagtc

SEQ ID NO: 151 - DNA, 22 bp, Artificial Sequence
  Description of Artifical Sequence:  Primer/Probe
accttaagtcctgccaacaatt

SEQ ID NO: 152 - DNA, 26 bp, Artificial Sequence
  Description of Artifical Sequence:  Primer/Probe
ttacagagtccaaattgtggatccca

SEQ ID NO: 153 - DNA, 21 bp, Artificial Sequence
  Description of Artifical Sequence:  Primer/Probe
tgatcccttccagaatttgac

SEQ ID NO: 154 - DNA, 19 bp, Artificial Sequence
  Description of Artifical Sequence:  Primer/Probe
gagccagggctgctgtata

SEQ ID NO: 155 - DNA, 26 bp, Artificial Sequence
  Description of Artifical Sequence:  Primer/Probe
cctctcaggaacatgctaccaaaatt

SEQ ID NO: 156 - DNA, 20 bp, Artificial Sequence
  Description of Artifical Sequence:  Primer/Probe
tagattgagggcagcagtca

SEQ ID NO: 157 - DNA, 20 bp, Artificial Sequence
  Description of Artifical Sequence:  Primer/Probe
aactgccactggtgacactt

SEQ ID NO: 158 - DNA, 28 bp, Artificial Sequence
  Description of Artifical Sequence:  Primer/Probe
cacactcagtgtcggttaaaattactga

SEQ ID NO: 159 - DNA, 21 bp, Artificial Sequence
  Description of Artifical Sequence:  Primer/Probe
tgaattcttccaccatgagaa

SEQ ID NO: 160 - DNA, 21 bp, Artificial Sequence
  Description of Artifical Sequence:  Primer/Probe
atttggctatcccttcaggtt

SEQ ID NO: 161 - DNA, 25 bp, Artificial Sequence
  Description of Artifical Sequence:  Primer/Probe
cggatccaatatgagatgcccctct

SEQ ID NO: 162 - DNA, 22 bp, Artificial Sequence
  Description of Artifical Sequence:  Primer/Probe
gtcttggagctggactcttcat

SEQ ID NO: 163 - DNA, 22 bp, Artificial Sequence
  Description of Artifical Sequence:  Primer/Probe
accaggatgagtttgtgtcatc

SEQ ID NO: 164 - DNA, 25 bp, Artificial Sequence
  Description of Artifical Sequence:  Primer/Probe
ctcaagatcccttcggacacgctgt

SEQ ID NO: 165 - DNA, 22 bp, Artificial Sequence
  Description of Artifical Sequence:  Primer/Probe
tgcggaagctgtacacatagta

SEQ ID NO: 166 - DNA, 22 bp, Artificial Sequence
  Description of Artifical Sequence:  Primer/Probe
accaggatgagtttgtgtcatc

SEQ ID NO: 167 - DNA, 25 bp, Artificial Sequence
  Description of Artifical Sequence:  Primer/Probe
ctcaagatcccttcggacacgctgt

SEQ ID NO: 168 - DNA, 22 bp, Artificial Sequence
  Description of Artifical Sequence:  Primer/Probe
tgcggaagctgtacacatagta

SEQ ID NO: 169 - DNA, 22 bp, Artificial Sequence
  Description of Artifical Sequence:  Primer/Probe
tagttatctacctgcgcttcca

SEQ ID NO: 170 - DNA, 26 bp, Artificial Sequence
  Description of Artifical Sequence:  Primer/Probe
tctacacagagaacaaacgcttcccg

SEQ ID NO: 171 - DNA, 22 bp, Artificial Sequence
  Description of Artifical Sequence:  Primer/Probe
gaaggtgaaggagacagtcaca

SEQ ID NO: 172 - DNA, 20 bp, Artificial Sequence
  Description of Artifical Sequence:  Primer/Probe
gacctggtgtacatggagga

SEQ ID NO: 173 - DNA, 23 bp, Artificial Sequence
  Description of Artifical Sequence:  Primer/Probe
cttctgccggcccagcaagtact

SEQ ID NO: 174 - DNA, 19 bp, Artificial Sequence
  Description of Artifical Sequence:  Primer/Probe
gagcacaccctacctgctg

SEQ ID NO: 175 - DNA, 21 bp, Artificial Sequence
  Description of Artifical Sequence:  Primer/Probe
gtccaagagaggaaacaagga

SEQ ID NO: 176 - DNA, 24 bp, Artificial Sequence
  Description of Artifical Sequence:  Primer/Probe
cacaatacccacgtgggcatcaag

SEQ ID NO: 177 - DNA, 20 bp, Artificial Sequence
  Description of Artifical Sequence:  Primer/Probe
gtcctgaggccactcttcac

SEQ ID NO: 178 - DNA, 20 bp, Artificial Sequence
  Description of Artifical Sequence:  Primer/Probe
ggatgactcgcctagcttct

SEQ ID NO: 179 - DNA, 23 bp, Artificial Sequence
  Description of Artifical Sequence:  Primer/Probe
gccgtaggtgccaccgtgagaag

SEQ ID NO: 180 - DNA, 19 bp, Artificial Sequence
  Description of Artifical Sequence:  Primer/Probe
agcagatgctctcgcagtt

SEQ ID NO: 181 - DNA, 22 bp, Artificial Sequence
  Description of Artifical Sequence:  Primer/Probe
cattgagagcgataagttcaca

SEQ ID NO: 182 - DNA, 26 bp, Artificial Sequence
  Description of Artifical Sequence:  Primer/Probe
agaatgtggagctcaacatccacctg

SEQ ID NO: 183 - DNA, 20 bp, Artificial Sequence
  Description of Artifical Sequence:  Primer/Probe
gatgcacgctgaagtcattc

SEQ ID NO: 184 - DNA, 22 bp, Artificial Sequence
  Description of Artifical Sequence:  Primer/Probe
ctctggggactcctaatttctg

SEQ ID NO: 185 - DNA, 26 bp, Artificial Sequence
  Description of Artifical Sequence:  Primer/Probe
cccagcctaaagcagggatcagtctt

SEQ ID NO: 186 - DNA, 22 bp, Artificial Sequence
  Description of Artifical Sequence:  Primer/Probe
tccaaggatttattccacaaga

SEQ ID NO: 187 - DNA, 20 bp, Artificial Sequence
  Description of Artifical Sequence:  Primer/Probe
acgaggtcttcatcaagctg

SEQ ID NO: 188 - DNA, 26 bp, Artificial Sequence
  Description of Artifical Sequence:  Primer/Probe
caccaacaagtacagcaccttctccg

SEQ ID NO: 189 - DNA, 20 bp, Artificial Sequence
  Description of Artifical Sequence:  Primer/Probe
cagtcggggtagatgatgaa

SEQ ID NO: 190 - DNA, 22 bp, Artificial Sequence
  Description of Artifical Sequence:  Primer/Probe
accaggatgagtttgtgtcatc

SEQ ID NO: 191 - DNA, 25 bp, Artificial Sequence
  Description of Artifical Sequence:  Primer/Probe
ctcaagatcccttcggacacgctgt

SEQ ID NO: 192 - DNA, 22 bp, Artificial Sequence
  Description of Artifical Sequence:  Primer/Probe
tgcggaagctgtacacatagta

SEQ ID NO: 193 - DNA, 22 bp, Artificial Sequence
  Description of Artifical Sequence:  Primer/Probe
accaggatgagtttgtgtcatc

SEQ ID NO: 194 - DNA, 25 bp, Artificial Sequence
  Description of Artifical Sequence:  Primer/Probe
ctcaagatcccttcggacacgctgt

SEQ ID NO: 195 - DNA, 22 bp, Artificial Sequence
  Description of Artifical Sequence:  Primer/Probe
tgcggaagctgtacacatagta

SEQ ID NO: 196 - DNA, 32 bp, Artificial Sequence
  Description of Artifical Sequence:  Primer/Probe
agatctcaggtagatgtttccaatgtcgttcc

SEQ ID NO: 197 - DNA, 35 bp, Artificial Sequence
  Description of Artifical Sequence:  Primer/Probe
ctcgaggctagcgttacataagcactgtattcaac

SEQ ID NO: 198 - DNA, 41 bp, Artificial Sequence
  Description of Artifical Sequence:  Primer/Probe
ggatcctcccgcgggccagcgcactacgagatgctgggtcg

SEQ ID NO: 199 - DNA, 50 bp, Artificial Sequence
  Description of Artifical Sequence:  Primer/Probe
ctcgaggtcggggtagatgatgaagccggagaaggtgctgtacttgttgg

SEQ ID NO: 200 - DNA, 18 bp, Artificial Sequence
  Description of Artifical Sequence:  Primer/Probe
gccctcccggtccaggtc

SEQ ID NO: 201 - DNA, 19 bp, Artificial Sequence
  Description of Artifical Sequence:  Primer/Probe
ggcgacggcaccagcatgt

SEQ ID NO: 202 - DNA, 19 bp, Artificial Sequence
  Description of Artifical Sequence:  Primer/Probe
gcctggcctgccgggttct

SEQ ID NO: 203 - DNA, 19 bp, Artificial Sequence
  Description of Artifical Sequence:  Primer/Probe
catgagcacgtggtaagcg

SEQ ID NO: 204 - DNA, 24 bp, Artificial Sequence
  Description of Artifical Sequence:  Primer/Probe
gtgctggcattggagtgtttagtg

SEQ ID NO: 205 - DNA, 25 bp, Artificial Sequence
  Description of Artifical Sequence:  Primer/Probe
atcaagcacgttgacacagaatgag

SEQ ID NO: 206 - DNA, 27 bp, Artificial Sequence
  Description of Artifical Sequence:  Primer/Probe
gcattcactaacctaacaccatttaca

SEQ ID NO: 207 - DNA, 27 bp, Artificial Sequence
  Description of Artifical Sequence:  Primer/Probe
gttcagcagagatgtcgtctgaccttc

SEQ ID NO: 208 - DNA, 25 bp, Artificial Sequence
  Description of Artifical Sequence:  Primer/Probe
gggatcctccagatcctgtattttt

SEQ ID NO: 209 - DNA, 27 bp, Artificial Sequence
  Description of Artifical Sequence:  Primer/Probe
tgaagaacacatcaacaacagacataa

SEQ ID NO: 210 - DNA, 27 bp, Artificial Sequence
  Description of Artifical Sequence:  Primer/Probe
actgttttcagcagctaccttaatttc

SEQ ID NO: 211 - DNA, 24 bp, Artificial Sequence
  Description of Artifical Sequence:  Primer/Probe
cttgatgaatgtgtggtacgcgat

SEQ ID NO: 212 - DNA, 26 bp, Artificial Sequence
  Description of Artifical Sequence:  Primer/Probe
gtgaatgcaaacttgaggtcttttgt

SEQ ID NO: 213 - DNA, 29 bp, Artificial Sequence
  Description of Artifical Sequence:  Primer/Probe
cctcatataatcctaccattggctgtact

SEQ ID NO: 214 - DNA, 27 bp, Artificial Sequence
  Description of Artifical Sequence:  Primer/Probe
gaggatcccagtgtaaaaatacttctg

SEQ ID NO: 215 - DNA, 27 bp, Artificial Sequence
  Description of Artifical Sequence:  Primer/Probe
tagcacttcataagcaataatgatccc

SEQ ID NO: 216 - DNA, 28 bp, Artificial Sequence
  Description of Artifical Sequence:  Primer/Probe
tgagtgtactagcagacacctcaatgat

SEQ ID NO: 217 - DNA, 887 bp, Homo sapiens
  CDS (19)..(879)
gtcggcgtactcttggccatggcgctcgggctgctcatcgccgtgccgctgctgctgcaggcggcgccccgaggcgccgcgcactatgagatgatgggcacctgccgcatgatctgcgacccttacactgccgcgcccggcggggagcccccgggtgcaaaggcgcagccacccggacccagcaccgccgccctggaagtcatgcaggacctcagcgccaaccctcctcctcctttcatccagggacccaagggcgacccggggcgaccgggcaagccagggccgcgggggccccctggagagccgggcccgcctggacccaggggccctccgggagagaagggcgactcggggaggcccgggctgccagggctgcaactgacggcgggcacggccagcggcgtcggggtggtgggcggcggggccggggtaggtggcgattccgagggtgaagtgaccagtgcgctgagcgccaccttcagcggccccaagatcgccttctatgtgggtctcaagagcccccacgaaggctatgaggtgctgaagttcgatgacgtggtcaccaacctcggcaatcactatgaccccaccacgggcaagttcagctgccaggtacgcggcatctacttcttcacctaccacatcctcatgcgcggcggcgacggcaccagcatgtgggcggacctctgcaagaacgggcaggtccgggccagcgccattgcacaggacgccgaccagaactacgactacgccagtaacagcgtggtgctgcacttggattcaggggacgaagtgtatgtgaagctggatggcgggaaggctcacggaggcaataataacaagtacagcacgttctcgggctttcttctgtacccggattaggggcg

SEQ ID NO: 218 - protein, 287 aa, Homo sapiens
MALGLLIAVPLLLQAAPRGAAHYEMMGTCRMICDPYTAAPGGEPPGAKAQPPGPSTAALEVMQDLSANPPPPFIQGPKGDPGRPGKPGPRGPPGEPGPPGPRGPPGEKGDSGRPGLPGLQLTAGTASGVGVVGGGAGVGGDSEGEVTSALSATFSGPKIAFYVGLKSPHEGYEVLKFDDVVTNLGNHYDPTTGKFSCQVRGIYFFTYHILMRGGDGTSMWADLCKNGQVRASAIAQDADQNYDYASNSVVLHLDSGDEVYVKLDGGKAHGGNNNKYSTFSGFLLYPD

SEQ ID NO: 219 - protein, 94 aa, Artificial Sequence
  Description of Artificial Sequence: Domain
PYADEPDEGKPEYWTGYFTSRPALKRLDRQLEHLLRSAEILATQLSVLAGQSKIEGSYAIKLEKLYEQLEELRRALALFQHHDAITGTAKQHVV

SEQ ID NO: 220 - protein, 253 aa, Homo sapiens
MMMKIPWGSIPVLMLLLLLGLIDISQAQLSCTGPPAIPGIPGIPGTPGPDGQPGTPGIKGEKGLPGLAGDHGEFGEKGDPGIPGNPGKVGPKGPMGPKGGPGAPGAPGPKGESGDYKATQKIAFSATRTINVPLRRDQTIRFDHVITNMNNNYEPRSGKFTCKVPGLYYFTYHASSRGNLCVNLMRGRERAQKVVTFCDYAYNTFQVTTGGMVLKLEQGENVFLQATDKNSLLGMEGANSIFSGFLLFPDMEA

What is claimed is:

1. An isolated nucleic acid molecule comprising a nucleic acid sequence encoding a polypeptide comprising an amino acid sequence SEQ ID NO: 4.

2. The nucleic acid molecule of claim 1, wherein the nucleic acid molecule comprises the nucleotide sequence SEQ ID NO: 3.

3. The nucleic acid molecule of claim 1, wherein the nucleic acid molecule encodes a polypeptide consisting of the amino acid sequence SEQ ID NO: 4.

4. The nucleic acid molecule of claim 1, wherein the nucleic acid molecule consists of the nucleic acid sequence SEQ ID NO: 3.

5. The nucleic acid molecule of claim 1, wherein said nucleic acid molecule comprises the nucleic acid sequence SEQ ID NO: 3.

6. A vector comprising the nucleic acid molecule of claim 1.

7. The vector of claim 6, further comprising a promoter operably-linked to said nucleic acid molecule.

8. An isolated cell comprising the vector of claim 6.

9. A composition comprising the nucleic acid molecule of claim 1 and a carrier.

10. A kit comprising in one or more containers, the composition of claim 9.

* * * * *